US012674152B2

(12) United States Patent
Moxley et al.

(10) Patent No.: US 12,674,152 B2
(45) Date of Patent: Jul. 7, 2026

(54) PROCESSES FOR PRODUCING A FERMENTATION PRODUCT FROM STARCH-CONTAINING MATERIAL USING POLYPEPTIDES HAVING PECTINASE ACTIVITY

(71) Applicant: Novozymes A/S, Bagsvaerd (DK)

(72) Inventors: Geoffrey Moxley, Wake Forest, NC (US); Mercy Wada, Davis, CA (US); Monica Tassone, West Sacramento, CA (US); Mary Ann Stringer, Søborg (DK); Hong Zhi Huang, Beijing (CN); Nikolaj Spodsberg, Holte (DK); Tianqi Sun, Beijing (CN); Sara Maria Landvik, Vedbaek (DK); James Lavigne, Wake Forest, NC (US); Cui Liu, Beijing (CN)

(73) Assignee: Novozymes A/S, Bagsvaerd (DK)

( * ) Notice: Subject to any disclaimer, the term of this patent is extended or adjusted under 35 U.S.C. 154(b) by 240 days.

(21) Appl. No.: 18/262,864

(22) PCT Filed: Feb. 7, 2022

(86) PCT No.: PCT/US2022/015478

§ 371 (c)(1),
(2) Date: Jul. 25, 2023

(87) PCT Pub. No.: WO2022/173694

PCT Pub. Date: Aug. 18, 2022

(65) Prior Publication Data

US 2024/0117331 A1 Apr. 11, 2024

(30) Foreign Application Priority Data

Feb. 10, 2021 (WO) ................ PCT/CN2021/076442

(51) Int. Cl.
*C12P 7/06* (2006.01)
*C12N 9/24* (2006.01)
*C12N 15/63* (2006.01)
*C12P 19/14* (2006.01)

(52) U.S. Cl.
CPC ........... *C12N 9/2402* (2013.01); *C12N 15/63* (2013.01); *C12P 19/14* (2013.01); *C12Y 302/01015* (2013.01)

(58) Field of Classification Search
CPC ....... C12N 9/2402; C12N 15/63; C12P 19/14; C12P 7/10; C12P 7/06
See application file for complete search history.

(56) References Cited

U.S. PATENT DOCUMENTS

| | | | | |
|---|---|---|---|---|
| 7,504,490 | B1 | 3/2009 | Weinstock et al. | |
| 10,875,889 | B2 | 12/2020 | Jakel | |
| 10,876,141 | B2 * | 12/2020 | Zavrel | C12P 7/08 |
| 2008/0026101 | A1 | 1/2008 | Nickel et al. | |
| 2014/0004588 | A1 | 1/2014 | Doran Peterson | |
| 2014/0141472 | A1 | 5/2014 | Berka et al. | |
| 2015/0184189 | A1 | 7/2015 | Abad et al. | |
| 2015/0307562 | A1 | 10/2015 | Basu et al. | |
| 2016/0201041 | A1 | 7/2016 | Jump | |
| 2017/0145443 | A1 | 5/2017 | Shihadeh | |
| 2017/0166834 | A1 | 6/2017 | Jakel | |
| 2018/0073040 | A1 | 3/2018 | Headman | |
| 2018/0105841 | A1 | 4/2018 | Headman et al. | |
| 2018/0119189 | A1 * | 5/2018 | Zavrel | C13K 1/02 |
| 2019/0338319 | A1 | 11/2019 | Yazdi | |
| 2021/0062122 | A1 | 3/2021 | Franko et al. | |
| 2022/0112450 | A1 | 4/2022 | Jakel | |
| 2022/0287332 | A1 | 9/2022 | Jakel et al. | |

FOREIGN PATENT DOCUMENTS

| | | | |
|---|---|---|---|
| CN | 104448011 | A | 3/2015 |
| CN | 108239649 | A | 7/2018 |
| JP | 2011155933 | A | 8/2011 |
| WO | 9414966 | A1 | 7/1994 |
| WO | 9502689 | A1 | 1/1995 |
| WO | 2004056988 | A2 | 7/2004 |
| WO | 2004074468 | A1 | 9/2004 |
| WO | 2009074156 | A1 | 6/2009 |
| WO | 2010046471 | A2 | 4/2010 |
| WO | 2010096510 | A2 | 8/2010 |
| WO | 2010109203 | A1 | 9/2010 |
| WO | 2010138110 | A1 | 12/2010 |
| WO | 2012027374 | A2 | 3/2012 |
| WO | 2012084225 | A1 | 6/2012 |
| WO | 2013016115 | A1 | 1/2013 |
| WO | 2013181760 | A1 | 12/2013 |
| WO | 2014059541 | A1 | 4/2014 |
| WO | 2014081884 | A1 | 5/2014 |
| WO | 2014138983 | A1 | 9/2014 |
| WO | 2014202616 | A2 | 12/2014 |
| WO | 2015048332 | A2 | 4/2015 |
| WO | 2015057520 | A1 | 4/2015 |
| WO | 2015109405 | A1 | 7/2015 |
| WO | 2016090474 | A1 | 6/2016 |
| WO | 2017088820 | A1 | 6/2017 |
| WO | 2018127486 | A1 | 7/2018 |
| WO | 2018204483 | A2 | 11/2018 |
| WO | 2019014118 | A1 | 1/2019 |

(Continued)

OTHER PUBLICATIONS

CN104448011, Baolingbao Biology Co Ltd, 2015, Abstract.
Pedrolli et al., 2009, The open biotechnology journal 3, 9-18.
Zyl et al., 2007, Adv Biochem Engin / Biotechnol, 205-235.

*Primary Examiner* — Maryam Monshipouri
(74) *Attorney, Agent, or Firm* — David Fazzolare

(57) ABSTRACT

The present invention relates to isolated polypeptides having pectinase activity, and polynucleotides encoding the polypeptides. The invention also relates to nucleic acid constructs, vectors, and host cells comprising the polynucleotides as well as methods of producing and using the polypeptides.

1 Claim, 5 Drawing Sheets

Specification includes a Sequence Listing.

(56) References Cited

FOREIGN PATENT DOCUMENTS

| | | | |
|---|---|---|---|
| WO | 2020002574 | A1 | 1/2020 |
| WO | 2020002575 | A1 | 1/2020 |

* cited by examiner

PROCESSES FOR PRODUCING A FERMENTATION PRODUCT FROM STARCH-CONTAINING MATERIAL USING POLYPEPTIDES HAVING PECTINASE ACTIVITY

CROSS-REFERENCE TO RELATED APPLICATIONS

This application is a 35 U.S.C. 371 national application of international application no. PCT/US2022/015478 filed Feb. 7, 2022, which claims priority or the benefit under 35 U.S.C. 119 of Chinese application no. PCT/CN2021/076442 filed Feb. 10, 2021, the contents of which are fully incorporated herein by reference.

REFERENCE TO A SEQUENCE LISTING

This application contains a Sequence Listing in computer readable form. The contents of the electronic sequence listing created on Feb. 7, 2022, named SQ.txt and 649 KB in size, is hereby incorporated by reference in its entirety.

REFERENCE TO A DEPOSIT OF BIOLOGICAL MATERIAL

This application contains a reference to a deposit of biological material, which deposit is incorporated herein by reference.

BACKGROUND OF THE INVENTION

Field of the Invention

The present invention relates to polypeptides having pectinase activity (e.g., polygalacturonase, rhamnogalacturonase, pectin methyl esterase, pectate lyase, pectin acetyl esterase, rhamnogalacturonan lyase, etc.), and polynucleotides encoding the polypeptides, and to nucleic acid constructs, vectors, and host cells comprising the polynucleotides as well as methods of producing and using the polypeptides for degrading fiber (e.g., corn fiber). The present invention relates to processes for producing fermentation products, for example from starch-containing or cellulosic-containing material. The present invention also relates to an enzyme blend or composition, or a recombinant host cell or fermenting organism suitable for use in a process of the invention.

Description of the Related Art

Growing plant cells are surrounded by polysaccharide-rich cell wall layers, characterized as primary and secondary cell wall layers. One of the major functions of the primary plant cell wall is to impart structural and mechanical support in addition to providing protection against pathogens or other environmental factors. The primary cell walls of higher-order plant tissues including grasses and cereal grains, such as maize, are composed predominantly of three major polysaccharide families: cellulose, hemicellulose, and pectin. Secondary cell wall layers impart mechanical strength to the cell, but also have a prominent role in cell growth and division. The secondary cell wall layer also contains cellulose, hemicellulose, and pectin, although usually in different proportions than the primary cell wall, in addition to lignin which is a non-carbohydrate polymer composed of highly cross-linked phenolic molecules.

Pectins are a family of complex polysaccharides that are composed of a 1,4-alpha-D-galactosyluronic acid residues backbone. In the cell walls of plants in the grass family, including cereal grains such as maize, pectins are a relatively minor component of the cell wall structure but conversely have a relatively complex structure that is both chemically and physically associated with the hemicellulose component in both primary and secondary plant cell walls. Pectins can be classified into three main categories of either homogalacturonan, substituted galacturonans, or rhamnogalacturonans based on their physical structure.

Homogalacturonan is the simplest structural pectin composed of a linear chain of 1,4-alpha-D-galactosyluronic acid resides which can be partially methyl esterified and/or O-acetylated depending on the plant species and tissue. The linear backbone of 1,4-alpha-D-galactosyluronic acid residues can be hydrolyzed randomly at internal linkages by endo-polygalacturonase enzymes (e.g. EC 3.2.1.15) or sequentially from the non-reducing ends of the galactosyluronic acid chains by exo-polygalacturonases (e.g. EC 3.2.1.67). Methyl esterified and O-acetylated carboxylic groups on the homogalacturonan can sterically hinder or otherwise inhibit activity of polygalacturonases. Pectin esterases such as pectin methylesterase (e.g. EC 3.1.1.11) and pectin acetylesterase (e.g. EC 3.1.1.6) can catalyze demethyloxylation and deacetylation of the pectin chains and work synergistically with polygalacturonases to degrade homogalacturonan.

Pectin lyases (e.g. EC 4.2.2.10) also degrade polymeric residues of 1,4-alpha-D-galactosyluronic acid but require a certain degree of methyl esterification of the homogalacturonan to recognize the substrate. Whereas pectin esterases work together with polygalacturonases, demethyloxylation of the homogalacturonan may decrease specific activity of pectin lyase to the pectin.

More complex substitutions to the 1,4-alpha-D-galactosyluronic acid backbone differentiate homogalacturonan from substituted galacturonans or heterogalacturonan. The same families of enzymes that degrade homogalacturonan are also able to degrade heterogalacturonan but may require additional pectinolytic activities. Regions of pectin with significant galactose substitutions can be degraded by beta-galactanases (e.g. EC 3.2.1.181) which are associated with interaction with the hemicellulose component of plant cell walls. Other substituted regions of pectin such as xylogalacturonans are characterized by beta-D-xylopyranosyl residues attached to C-3 position of the galacturonan backbone have only been implicated with reproductive tissues in the plant.

The most complex pectic structures belong to the class of pectins called rhamnogalacturonans, sometimes referred to as "hairy" regions of pectin due to the significant number of branching substitutions from the backbone, as opposed to the "smooth" homogalacturonan regions which as described above have linear 1,4-alpha-D-galactosyluronic acid backbones. There are at least eleven different glycosyl residues associated with rhamnogalacturonan moieties, of which there have been observed common disaccharide and oligosaccharide structures associated with rhamnogalacturonan. While similar to polygalacturonanases, rhamnogalacturonanases (e.g., E.C. 3.2.1.171) are able to recognize rhamnogalacturonan moieties and are able more efficiently degrade these complex pectic structures than polygalacturonanases alone.

SEQ ID NO: 5 of W2018127486 is 100% identical to the polygalacturonase shown in SEQ ID NO: 2.

SEQ ID NO: 1017 of WO2018204483 is 99.5% identical to the polygalacturonase shown in SEQ ID NO: 5.

SEQ ID NO: 17 of WO2020002574 is 100% identical to the polygalacturonase shown in SEQ ID NO: 8.

SEQ ID NO: 7577 of WO2010/046471 and SEQ ID NO: 13 of JP2011/155933 are 87.8% identical to the polygalacturonase shown in SEQ ID NO: 11.

WO94/14966 discloses an *Aspergillus tubigensis* polypeptide that is 83.3% identical to the polygalacturonase shown in SEQ ID NO: 14.

SEQ ID NO: 83 of WO2004/074468 is 83.3% identical to the polygalacturonase shown in SEQ ID NO: 17.

WO2014/081884 discloses a polypeptide that is 77.7% identical to the polygalacturonase shown in SEQ ID NO: 20.

SEQ ID NO: 1018 of WO2018/204483 is 100% identical to the polygalacturonase shown in SEQ ID NO: 23.

SEQ ID NO: 404 of WO2014/059541 is 100% identical to the polygalacturonase shown in SEQ ID NO: 26.

SEQ ID NO: 4587 of WO2015/048332 and SEQ ID NO: 1031 of WO2014/081884 are 100% identical to the polygalacturonase shown in SEQ ID NO: 29.

SEQ ID NO: 5528 of WO2015/048332 and SEQ ID NO: 731 of WO2014/081884 are 100% identical to the polygalacturonase shown in SEQ ID NO: 32.

SEQ ID NO: 4599 of WO2015/048332 and SEQ ID NO: 709 of WO2014/081884 are 100% identical to the polygalacturonase shown in SEQ ID NO: 35.

SEQ ID NO: 4262 of WO2015/048332, SEQ ID NO: 2 of CN108239649, and SEQ ID NO: 12 of JP2011/155933 are 84.2% identical to the polygalacturonase shown in SEQ ID NO: 38.

SEQ ID NO: 4598 of WO2015/048332 and SEQ ID NO: 701 of WO2014/081884 are 87.8% identical to the polygalacturonase shown in SEQ ID NO: 41.

SEQ ID NO: 4974 of WO2015/048332 and SEQ ID NO: 698 of WO2014/081884 are 71.7% identical to the polygalacturonase shown in SEQ ID NO: 44.

SEQ ID NO: 31637 of WO2014/202616 is 82.2% identical to the rhamnogalacturonanase shown in SEQ ID NO: 47.

SEQ ID NO: 18 of WO2020002574, SEQ ID NO: 4340 of WO2015/048332, SEQ ID NO: 854 of WO2014/0081884, and SEQ ID NO: 32 of WO2009/074156 are 100% identical to the rhamnogalacturonanase shown in SEQ ID NO: 50.

SEQ ID NO: 2749 and 2891 of WO2013/181760 are 62.8% identical to the rhamnogalacturonanase shown in SEQ ID NO: 53.

SEQ ID NO: 2749 of WO2013/181760 is 61% identical to the rhamnogalacturonanase shown in SEQ ID NO: 56.

SEQ ID NO: 2891 of WO2013/181760 is 61.2% identical to the rhamnogalacturonanase shown in SEQ ID NO: 59.

SEQ ID NO: 67 from WO2004/074468, SEQ ID NOs: 852 and 1099 from WO2014/081884, and SEQ ID NOs: 4687 and 4762 of WO2015/048332 are 97.9% identical to the rhamnogalacturonanase shown in SEQ ID NO: 62.

SEQ ID NO: 5107 from WO2015/048332 and SEQ ID NO: 824 of WO2014/081884 are 100% identical to the pectin methyl esterase of SEQ ID NO: 65.

SEQ ID NO: 70 of WO2004/074468 and SEQ ID NO: 4245 of WO2015/048332 are 96% identical to the pectin methyl esterase shown in SEQ ID NO: 68.

SEQ ID NO: 70 of WO2004/074468 and SEQ ID NO: 4245 of WO2015/048332 are 72.5% identical to the pectin methyl esterase shown in SEQ ID NO: 71.

SEQ ID NO: 36136 of U.S. Pat. No. 7,504,490 is 75.4% identical to the pectin methyl esterase shown in SEQ ID NO: 74.

SEQ ID NOs: 2 and 3 of WO2020/002575 are 100% identical to the pectin lyase shown in SEQ ID NO: 77.

SEQ ID NO: 9 from WO2020/002574 and SEQ ID NO: 24 from WO2019/014118 are 100% identical to the pectin lyase shown in SEQ ID NO: 80.

SEQ ID NO: 78 from WO2004/074468 is 56.8% identical to the pectin acetyl esterase shown in SEQ ID NO: 83.

SEQ ID NO: 15 from WO2020/002574 is 100% identical to the pectin acetyl esterase shown in SEQ ID NO: 86.

WO95/02689 discloses a polypeptide that is 98.5% identical to the pectin acetyl esterase shown in SEQ ID NO: 89.

SEQ ID NO: 1197 from WO2015/109405 is 57.7% identical to the pectin acetyl esterase shown in SEQ ID NO: 92.

SEQ ID NO: 4799 of WO2015/048332 and SEQ ID NO: 833 of WO2014/081884 are 100% identical to the polygalacturonase shown in SEQ ID NO: 95.

SEQ ID NO: 4813 of WO2015/048332 and SEQ ID NO: 845 of WO2014/081884 are 100% identical to the polygalacturonase shown in SEQ ID NO: 98.

SEQ ID NO: 13 from WO2020/002574 is 100% identical to the pectin lyase shown in SEQ ID NO: 101.

WO2004/056988 discloses a polypeptide that is 100% identical to the beta-galactanase shown in SEQ ID NO: 104.

WO2014/138983 discloses a polypeptide that is 53.9% identical to the rhamnogalacturonan lyase shown in SEQ ID NO: 107.

WO2016090474 discloses a polypeptide that is 69.2% identical to the rhamnogalacturon lyase shown in SEQ ID NO: 140.

WO2010/046471 discloses a polypeptide that is 75.3% identical to the polygalacturonase shown in SEQ ID NO: 143.

WO2013/181760 discloses a polypeptide that is 61.0% identical to the rhamnogalacturonase shown in SEQ ID NO: 146.

In a process for producing ethanol from corn, following SSF or the RSH process, the liquid fermentation products are recovered from the fermented mash (often referred to as "beer mash"), e.g., by distillation, which separates the desired fermentation product, e.g. ethanol, from other liquids and/or solids. The remaining fraction is referred to as "whole stillage" which is largely composed of unfermentable polysaccharides derived from the primary and secondary cell walls of the corn kernel, protein, corn oil and waxes, and any unfermented residual starch. Whole stillage typically contains about 10 to 20% solids. The whole stillage is separated into a solid and a liquid fraction, e.g., by centrifugation. The separated solid fraction is referred to as "wet cake" (or "wet grains") and the separated liquid fraction is referred to as "thin stillage". Wet cake and thin stillage contain about 35 and 7% solids, respectively. Wet cake, with optional additional dewatering, is used as a component in animal feed or is dried to provide "Distillers Dried Grains" (DDG) used as a component in animal feed. Thin stillage is typically evaporated to provide evaporator condensate and syrup or may alternatively be recycled to the slurry tank as "backset". Evaporator condensate may either be forwarded to a methanator before being discharged and/or may be recycled to the slurry tank as "cook water". The syrup may be blended into DDG or added to the wet cake before or during the drying process, which can comprise one or more dryers in sequence, to produce DDGS (Distillers Dried Grain with Solubles). Syrup typically contains about 25% to 35% solids. Oil can also be extracted from the thin stillage and/or syrup as a by-product for use in biodiesel production, as a feed or food additive or product, or other biorenewable products.

Cellulose, which is present in the corn kernel cell walls, is a homopolysaccharide composed of 1,4-linked beta-D-glucose residues. Typically, cellulose is not fermentable in SSF or RSH processes for producing ethanol from corn due to the highly crystalline nature of cellulose fiber and inability of amylase enzymes added in the process to degrade cellulose into glucose. In processes where a cellulolytic enzyme is added into either an SSF or RSH process, a portion of the cellulose can be degraded into glucose which in turn can be metabolized by a fermentation organism (e.g., yeast) into additional ethanol, above any ethanol which would be produced from fermentation of glucose released from starch in the corn kernel. However due to the complex arrangement of cellulose fibers physically and chemically associated with other cell wall polysaccharides hemicellulose and pectin, cellulolytic enzymes are only able to access a small portion of the total cellulose in the corn kernel fiber present in the SSF or RSH process. Therefore, there is a need for a method of improving cellulose degradation during SSF and RSH processes whereby cellulolytic enzymes have a greater accessibility to the corn kernel fiber.

SUMMARY OF THE INVENTION

The present invention provides isolated or purified polypeptides having pectinase activity (e.g., polygalacturonase, rhamnogalacturonase, pectin methyl esterase, pectate lyase, pectin acetyl esterase, rhamnogalacturonan lyase, etc.) and polynucleotides encoding the polypeptides.

Accordingly, the present invention relates to isolated or purified polypeptides having pectinase selected from the group consisting of:

(a) a polypeptide having at least 60%, at least 65%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99%, or 100% sequence identity to SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO; 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 95, SEQ ID NO: 98, SEQ ID NO: 101, SEQ ID NO: 104, SEQ ID NO: 107, SEQ ID NO: 134, SEQ ID NO: 137, SEQ ID NO: 140, SEQ ID NO: 143, or SEQ ID NO: 146;

(b) a polypeptide having at least 60%, at least 65%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99%, or 100% sequence identity to the sequence of SEQ ID NO: 3, SEQ ID NO: 6, SEQ ID NO: 9, SEQ ID NO: 12, SEQ ID NO: 15, SEQ ID NO: 18, SEQ ID NO: 21, SEQ ID NO: 24, SEQ ID NO: 27, SEQ ID NO: 30, SEQ ID NO: 33, SEQ ID NO: 36, SEQ ID NO: 39, SEQ ID NO: 42, SEQ ID NO: 45, SEQ ID NO: 48, SEQ ID NO: 51, SEQ ID NO: 54, SEQ ID NO: 57, SEQ ID NO; 60, SEQ ID NO: 63, SEQ ID NO: 66, SEQ ID NO: 69, SEQ ID NO: 72, SEQ ID NO: 75, SEQ ID NO: 78, SEQ ID NO: 81, SEQ ID NO: 84, SEQ ID NO: 87, SEQ ID NO: 90, SEQ ID NO: 93, SEQ ID NO: 96, SEQ ID NO: 99, SEQ ID NO: 102, SEQ ID NO: 105, SEQ ID NO: 108, SEQ ID NO: 135, SEQ ID NO: 138, SEQ ID NO: 141, SEQ ID NO: 144, or SEQ ID NO: 147;

(c) a polypeptide having at least 60%, at least 65%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99%, or 100% sequence identity to a mature polypeptide of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO; 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 95, SEQ ID NO: 98, SEQ ID NO: 101, SEQ ID NO: 104, SEQ ID NO: 107, SEQ ID NO: 134, SEQ ID NO: 137, SEQ ID NO: 140, SEQ ID NO: 143, or SEQ ID NO: 146;

(d) a polypeptide encoded by a polynucleotide that hybridizes under medium, medium-high, high, or very high stringency conditions with the full-length complement of the mature polypeptide coding sequence of SEQ ID NO: 1, SEQ ID NO: 4, SEQ ID NO: 7, SEQ ID NO: 10, SEQ ID NO: 13, SEQ ID NO: 16, SEQ ID NO: 19, SEQ ID NO: 22, SEQ ID NO: 25, SEQ ID NO: 28, SEQ ID NO: 31, SEQ ID NO: 34, SEQ ID NO: 37, SEQ ID NO: 40, SEQ ID NO: 43, SEQ ID NO: 46, SEQ ID NO: 49, SEQ ID NO: 52, SEQ ID NO: 55, SEQ ID NO: 58, SEQ ID NO: 61, SEQ ID NO: 64, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 91, SEQ ID NO: 94, SEQ ID NO: 97, SEQ ID NO: 100, SEQ ID NO: 103, SEQ ID NO: 106, SEQ ID NO: 133, SEQ ID NO: 136, SEQ ID NO: 139, SEQ ID NO: 142, or SEQ ID NO: 145 or the cDNA sequences thereof;

(e) a polypeptide encoded by a polynucleotide having at least 60%, at least 65%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99%, or 100% sequence identity to the mature polypeptide coding sequence of SEQ ID NO: 1, SEQ ID NO: 4, SEQ ID NO: 7, SEQ ID NO: 10, SEQ ID NO: 13, SEQ ID NO:

16, SEQ ID NO: 19, SEQ ID NO: 22, SEQ ID NO: 25, SEQ ID NO: 28, SEQ ID NO: 31, SEQ ID NO: 34, SEQ ID NO: 37, SEQ ID NO: 40, SEQ ID NO: 43, SEQ ID NO: 46, SEQ ID NO: 49, SEQ ID NO: 52, SEQ ID NO: 55, SEQ ID NO: 58, SEQ ID NO: 61, SEQ ID NO: 64, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 91, SEQ ID NO: 94, SEQ ID NO: 97, SEQ ID NO: 100, SEQ ID NO: 103, or SEQ ID NO: 106, SEQ ID NO: 133, SEQ ID NO: 136, SEQ ID NO: 139, SEQ ID NO: 142, SEQ ID NO: 145, or the cDNA sequences thereof; and (f) a fragment of the polypeptide of (a), (b), (c), (d), or (e) that has pectinase activity.

The present invention also relates to isolated or purified polynucleotides encoding the polypeptides of the present invention; nucleic acid constructs; recombinant expression vectors; recombinant host cells comprising the polynucleotides; and methods of producing the polypeptides. The recombinant host cells (e.g., recombinant yeast host cells comprising heterologous polypeptides encoding the polypeptides of the present invention) can be used for the in situ expression of at least one polypeptide having pectinase activity in processes, such as during the fermentation or simultaneous saccharification and fermentation steps of ethanol production processes, to replace or reduce exogenous addition of the polypeptides.

The present invention also relates to use of at least one polypeptide having pectinase activity for degrading a fiber and processes of degrading a fiber comprising contacting the fiber with at least one polypeptide having pectinase activity, preferably wherein said fiber is a cereal fiber, such as from corn, wheat, rice, oats, and barley, wherein the process is carried out under acidic conditions having pH of 7.5 or less. In one aspect, the fiber is degraded in a process for producing a fermentation product from starch-containing material, wherein a partially degraded starch-containing material containing fiber is contacted with at least one polypeptide having pectinase activity during saccharification, fermentation, or simultaneous saccharification and fermentation to produce the fermentation product. In an embodiment, at least one polypeptide having pectinase activity is used to degrade fiber during production of an alcohol, for example, by applying the at least one polypeptide during the saccharification, fermentation, or simultaneous saccharification and fermentation (SSF) step of a process for producing fuel ethanol from corn (including both conventional processes having a high temperature liquefaction step using enzymes (e.g., alpha-amylase and/or protease) and raw starch hydrolysis processes carried out below the gelatinization temperature of the corn). The at least one polypeptide can be applied by exogenous addition during the saccharification, fermentation, or simultaneous saccharification and fermentation (SSF) steps, or via in situ expression of the polypeptides during fermentation or SSF by a recombinant host cell (e.g., a recombinant yeast host cell comprising heterologous polynucleotides encoding at least one polypeptide having pectinase activity of the present invention).

DEFINITIONS

Figure 1:
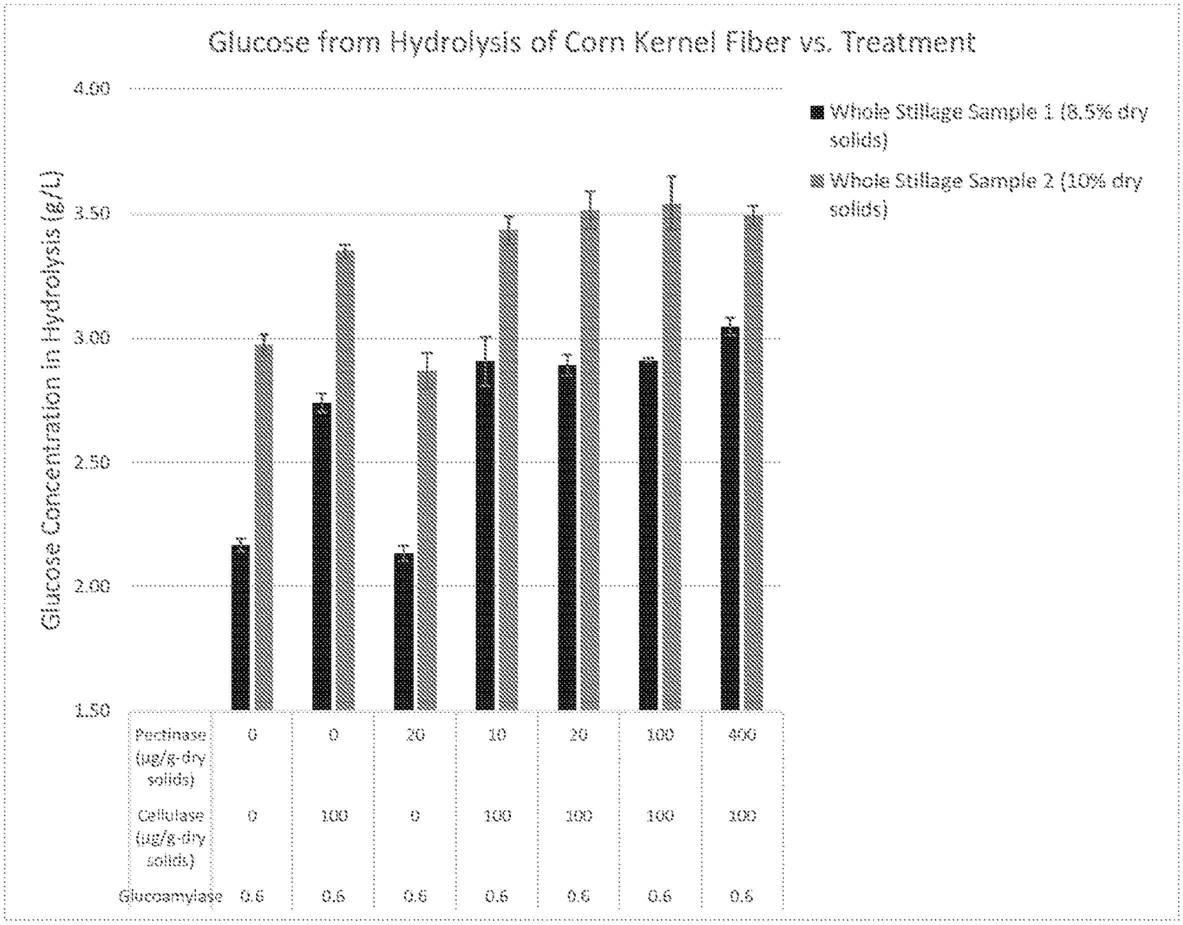
FIG. 1 shows a dose response of pectinase enzymes demonstrating synergistic effect of pectinolytic activities on glucan solubilization in hydrolysis of corn kernel fiber at 8.5%-10% dry solids.

In accordance with this detailed description, the following definitions apply. Note that the singular forms "a," "an," and "the" include plural references unless the context clearly dictates otherwise.

Reference to "about" a value or parameter herein includes aspects that are directed to that value or parameter per se. For example, description referring to "about X" includes the aspect "X".

Unless defined otherwise or clearly indicated by context, all technical and scientific terms used herein have the same meaning as commonly understood by one of ordinary skill in the art to which this invention belongs.

Alpha-Amylases: Alpha-amylases (E.C. 3.2.1.1) are a group of enzymes which catalyze the hydrolysis of starch and other linear and branched 1,4 glucosidic oligo- and polysaccharides. The skilled person will know how to determine alpha-amylase activity.

Beta-glucosidase: The term "beta-glucosidase" means a beta-D-glucoside glucohydrolase (E.C. 3.2.1.21) that catalyzes the hydrolysis of terminal non-reducing beta-D-glucose residues with the release of beta-D-glucose. Beta-glucosidase activity can be determined using p-nitrophenyl-beta-D-glucopyranoside as substrate according to the procedure of Venturi et al., 2002, *J. Basic Microbiol.* 42: 55-66. One unit of beta-glucosidase is defined as 1.0 μmole of p-nitrophenolate anion produced per minute at 25° C., pH 4.8 from 1 mM p-nitrophenyl-beta-D-glucopyranoside as substrate in 50 mM sodium citrate containing 0.01% TWEEN® 20.

Beta-xylosidase: The term "beta-xylosidase" means a beta-D-xyloside xylohydrolase (E.C. 3.2.1.37) that catalyzes the exo-hydrolysis of short beta (1→4)-xylooligosaccharides to remove successive D-xylose residues from non-reducing termini. Beta-xylosidase activity can be determined using 1 mM p-nitrophenyl-beta-D-xyloside as substrate in 100 mM sodium citrate containing 0.01% TWEEN® 20 at pH 5, 40° C. One unit of beta-xylosidase is defined as 1.0 μmole of p-nitrophenolate anion produced per minute at 40° C., pH 5 from 1 mM p-nitrophenyl-beta-D-xyloside in 100 mM sodium citrate containing 0.01% TWEEN® 20.

Binding module: The term "carbohydrate binding module" means the region within a carbohydrate-active enzyme that provides carbohydrate-binding activity (Boraston et al., 2004, *Biochem. J.* 383: 769-781). A majority of known carbohydrate binding modules (CBMs) are contiguous amino acid sequences with a discrete fold. The carbohydrate binding module (CBM) is typically found either at the N-terminal or at the C-terminal extremity of an enzyme. Some CBMs are known to have specificity for cellulose. Carbohydrate binding modules of the present invention have cellulose binding (A-type) specificity.

Catalase: The term "catalase" means a hydrogen-peroxide:hydrogen-peroxide oxidoreductase (EC 1.11.1.6) that catalyzes the conversion of $2H_2O_2$ to $O_2+2H_2O$. For purposes of the present invention, catalase activity is determined according to U.S. Pat. No. 5,646,025. One unit of catalase activity equals the amount of enzyme that catalyzes the oxidation of 1 μmole of hydrogen peroxide under the assay conditions.

Catalytic domain: The term "catalytic domain" means the region of an enzyme containing the catalytic machinery of the enzyme.

cDNA: The term "cDNA" means a DNA molecule that can be prepared by reverse transcription from a mature, spliced, mRNA molecule obtained from a eukaryotic or prokaryotic cell. cDNA lacks intron sequences that may be present in the corresponding genomic DNA. The initial, primary RNA transcript is a precursor to mRNA that is processed through a series of steps, including splicing, before appearing as mature spliced mRNA.

Cellobiohydrolase: The term "cellobiohydrolase" means a 1,4-beta-D-glucan cellobiohydrolase (E.C. 3.2.1.91 and E.C. 3.2.1.176) that catalyzes the hydrolysis of 1,4-beta-D-glucosidic linkages in cellulose, cellooligosaccharides, or any beta-1,4-linked glucose containing polymer, releasing cellobiose from the reducing end (cellobiohydrolase I) or non-reducing end (cellobiohydrolase II) of the chain (Teeri, 1997, *Trends in Biotechnology* 15: 160-167; Teen et al., 1998, *Biochem. Soc. Trans.* 26: 173-178). Cellobiohydrolase activity can be determined according to the procedures described by Lever et al., 1972, *Anal. Biochem.* 47: 273-279; van Tilbeurgh et al., 1982, *FEBS Letters* 149: 152-156; van Tilbeurgh and Claeyssens, 1985, *FEBS Letters* 187: 283-288; and Tomme et al., 1988, *Eur. J. Biochem.* 170: 575-581.

Cellulolytic enzyme, cellulolytic composition, or cellulase: Cellulolytic enzyme, cellulolytic composition, or cellulase: The term "cellulolytic enzyme", "cellulolytic composition", or "cellulase" means one or more (e.g., several) enzymes that hydrolyze a cellulosic material. Such enzymes include endoglucanase(s), cellobiohydrolase(s), beta-glucosidase(s), or combinations thereof. The two basic approaches for measuring cellulolytic activity include: (1) measuring the total cellulolytic activity, and (2) measuring the individual cellulolytic activities (endoglucanases, cellobiohydrolases, and beta-glucosidases) as reviewed in Zhang et al., Outlook for cellulase improvement: Screening and selection strategies, 2006, *Biotechnology Advances* 24: 452-481. Total cellulolytic activity is usually measured using insoluble substrates, including Whatman No 1 filter paper, microcrystalline cellulose, bacterial cellulose, algal cellulose, cotton, pretreated lignocellulose, etc. The most common total cellulolytic activity assay is the filter paper assay using Whatman No 1 filter paper as the substrate. The assay was established by the International Union of Pure and Applied Chemistry (IUPAC) (Ghose, 1987, Measurement of cellulase activities, *Pure Appl. Chem.* 59: 257-68).

Cellulolytic enzyme activity is determined by measuring the increase in hydrolysis of a cellulosic material by cellulolytic enzyme(s) under the following conditions: 1-50 mg of cellulolytic enzyme protein/g of cellulose in Pretreated Corn Stover ("PCS") (or other pretreated cellulosic material) for 3-7 days at a suitable temperature, e.g., 50° C., 55° C., or 60° C., compared to a control hydrolysis without addition of cellulolytic enzyme protein. Typical conditions are 1 ml reactions, washed or unwashed PCS, 5% insoluble solids, 50 mM sodium acetate pH 5, 1 mM $MnSO_4$, 50° C., 55° C., or 60° C., 72 hours, sugar analysis by AMINEX® HPX-87H column (Bio-Rad Laboratories, Inc., Hercules, CA, USA).

Cellulosic material: The term "cellulosic material" means any material containing cellulose. The predominant polysaccharide in the primary cell wall of biomass is cellulose, the second most abundant is hemicellulose, and the third is pectin. The secondary cell wall, produced after the cell has stopped growing, also contains polysaccharides and is strengthened by polymeric lignin covalently cross-linked to hemicellulose. Cellulose is a homopolymer of anhydrocellobiose and thus a linear beta-(1-4)-D-glucan, while hemicelluloses include a variety of compounds, such as xylans, xyloglucans, arabinoxylans, and mannans in complex branched structures with a spectrum of substituents. Although generally polymorphous, cellulose is found in plant tissue primarily as an insoluble crystalline matrix of parallel glucan chains. Hemicelluloses usually hydrogen bond to cellulose, as well as to other hemicelluloses, which help stabilize the cell wall matrix.

Cellulose is generally found, for example, in the stems, leaves, hulls, husks, and cobs of plants or leaves, branches, and wood of trees. The cellulosic material can be, but is not limited to, agricultural residue, herbaceous material (including energy crops), municipal solid waste, pulp and paper mill residue, waste paper, and wood (including forestry residue) (see, for example, Wiselogel et al., 1995, in Handbook on Bioethanol (Charles E. Wyman, editor), pp. 105-118, Taylor & Francis, Washington D.C.; Wyman, 1994, Bioresource Technology 50: 3-16; Lynd, 1990, Applied Biochemistry and Biotechnology 24/25: 695-719; Mosier et al., 1999, Recent Progress in Bioconversion of Lignocellulosics, in Advances in Biochemical Engineering/Biotechnology, T. Scheper, managing editor, Volume 65, pp. 23-40, Springer-Verlag, New York). It is understood herein that the cellulose may be in the form of lignocellulose, a plant cell wall material containing lignin, cellulose, and hemicellulose in a mixed matrix. In one aspect, the cellulosic material is any biomass material. In another aspect, the cellulosic material is lignocellulose, which comprises cellulose, hemicelluloses, and lignin.

Coding sequence: The term "coding sequence" means a polynucleotide, which directly specifies the amino acid sequence of a polypeptide. The boundaries of the coding sequence are generally determined by an open reading frame, which begins with a start codon, such as ATG, GTG, or TTG, and ends with a stop codon, such as TAA, TAG, or TGA. The coding sequence may be a genomic DNA, cDNA, synthetic DNA, or a combination thereof.

Control sequences: The term "control sequences" means nucleic acid sequences necessary for expression of a polynucleotide encoding a polypeptide of the present invention. Each control sequence may be native (i.e., from the same gene) or heterologous (i.e., from a different gene) to the polynucleotide encoding the polypeptide or native or heterologous to each other. Such control sequences include, but are not limited to, a leader, polyadenylation sequence, propeptide sequence, promoter, signal peptide sequence, and transcription terminator. At a minimum, the control sequences include a promoter, and transcriptional and translational stop signals. The control sequences may be provided with linkers for the purpose of introducing specific restriction sites facilitating ligation of the control sequences with the coding region of the polynucleotide encoding a polypeptide.

Endoglucanase: The term "endoglucanase" means a 4-(1,3;1,4)-beta-D-glucan 4-glucanohydrolase (E.C. 3.2.1.4) that catalyzes endohydrolysis of 1,4-beta-D-glycosidic linkages in cellulose, cellulose derivatives (such as carboxymethyl cellulose and hydroxyethyl cellulose), lichenin, beta-1,4 bonds in mixed beta-1,3-1,4 glucans such as cereal beta-D-glucans or xyloglucans, and other plant material containing cellulosic components. Endoglucanase activity can be determined by measuring reduction in substrate viscosity or increase in reducing ends determined by a reducing sugar assay (Zhang et al., 2006, *Biotechnology Advances* 24: 452-481). Endoglucanase activity can also be determined using carboxymethyl cellulose (CMC) as substrate according to the procedure of Ghose, 1987, *Pure and Appl. Chem.* 59: 257-268, at pH 5, 40° C.

Expression: The term "expression" means any step involved in the production of a polypeptide including, but not limited to, transcription, post-transcriptional modification, translation, post-translational modification, and secretion.

Expression vector: The term "expression vector" means a linear or circular DNA molecule that comprises a polynucleotide encoding a polypeptide and is operably linked to control sequences that provide for its expression.

Fermentable medium: The term "fermentable medium" or "fermentation medium" refers to a medium comprising one or more (e.g., two, several) sugars, such as glucose, fructose, sucrose, cellobiose, xylose, xylulose, arabinose, mannose, galactose, and/or soluble oligosaccharides, wherein the medium is capable, in part, of being converted (fermented) by a host cell into a desired product, such as ethanol. In some instances, the fermentation medium is derived from a natural source, such as sugar cane, starch, or cellulose. The term fermentation medium is understood herein to refer to a medium before the fermenting organism is added, such as, a medium resulting from a saccharification process, as well as a medium used in a simultaneous saccharification and fermentation process (SSF).

Fragment: The term "fragment" means a polypeptide, a catalytic domain, or a carbohydrate binding module having one or more (e.g., several) amino acids absent from the amino and/or carboxyl terminus of a mature polypeptide or domain; wherein the fragment has pectinase activity, or carbohydrate binding activity.

Fusion polypeptide: The term "fusion polypeptide" is a polypeptide in which one polypeptide is fused at the N-terminus or the C-terminus of a polypeptide of the present invention. A fusion polypeptide is produced by fusing a polynucleotide encoding another polypeptide to a polynucleotide of the present invention. Techniques for producing fusion polypeptides are known in the art, and include ligating the coding sequences encoding the polypeptides so that they are in frame and that expression of the fusion polypeptide is under control of the same promoter(s) and terminator. Fusion polypeptides may also be constructed using intein technology in which fusion polypeptides are created post-translationally (Cooper et al., 1993, *EMBO J.* 12: 2575-2583; Dawson et al., 1994, *Science* 266: 776-779). A fusion polypeptide can further comprise a cleavage site between the two polypeptides. Upon secretion of the fusion protein, the site is cleaved releasing the two polypeptides. Examples of cleavage sites include, but are not limited to, the sites disclosed in Martin et al., 2003, *J. Ind. Microbiol. Biotechnol.* 3: 568-576; Svetina et al., 2000, *J. Biotechnol.* 76: 245-251; Rasmussen-Wilson et al., 1997, *Appl. Environ. Microbiol.* 63: 3488-3493; Ward et al., 1995, *Biotechnology* 13: 498-503; and Contreras et al., 1991, *Biotechnology* 9: 378-381; Eaton et al., 1986, *Biochemistry* 25: 505-512; Collins-Racie et al., 1995, *Biotechnology* 13: 982-987; Carter et al., 1989, *Proteins: Structure, Function, and Genetics* 6: 240-248; and Stevens, 2003, *Drug Discovery World* 4: 35-48.

Glucoamylase: The term "glucoamylase" (1,4-alpha-D-glucan glucohydrolase, EC 3.2.1.3) is defined as an enzyme, which catalyzes the release of D-glucose from the non-reducing ends of starch or related oligo- and polysaccharide molecules. The Glucoamylase Unit (AGU) is defined as the amount of enzyme, which hydrolyses 1 micromole maltose per minute under the standard conditions 37° C., pH 4.3, substrate: maltose 23.2 mM, buffer: acetate 0.1 M, reaction time 5 minutes.

Heterologous: The term "heterologous" means, with respect to a host cell, that a polypeptide or nucleic acid does not naturally occur in the host cell. The term "heterologous" means, with respect to a polypeptide or nucleic acid, that a control sequence, e.g., promoter, or domain of a polypeptide or nucleic acid is not naturally associated with the polypeptide or nucleic acid, i.e., the control sequence is from a gene other than the gene encoding the mature polypeptide of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 82, SEQ ID NO: 85, SEQ ID NO: 88, SEQ ID NO: 91, SEQ ID NO: 94, SEQ ID NO: 97, SEQ ID NO: 100, SEQ ID NO: 103, SEQ ID NO: 106, SEQ ID NO: 133, SEQ ID NO: 136, SEQ ID NO: 139, SEQ ID NO: 142, or SEQ ID NO: 145.

Host cell: The term "host cell" means any microbial or plant cell into which a nucleic acid construct or expression vector comprising a polynucleotide of the present invention has been introduced. Methods for introduction include but are not limited to protoplast fusion, transfection, transformation, electroporation, conjugation, and transduction. In some embodiments, the host cell is an isolated recombinant host cell that is partially or completely separated from at least one other component with, including but not limited to, proteins, nucleic acids, cells, etc.

Hemicellulolytic enzyme or hemicellulase: The term "hemicellulolytic enzyme" or "hemicellulase" means one or more (e.g., several) enzymes that hydrolyze a hemicellulosic material. See, for example, Shallom and Shoham, *Current Opinion In Microbiology*, 2003, 6(3): 219-228). Hemicellulases are key components in the degradation of plant biomass. Examples of hemicellulases include, but are not limited to, an acetylmannan esterase, an acetylxylan esterase, an arabinanase, an arabinofuranosidase, a coumaric acid esterase, a feruloyl esterase, a galactosidase, a glucuronidase, a glucuronoyl esterase, a GH5 mannanase, a GH26 mannanase, a mannosidase, a xylanase, and a xylosidase. The substrates for these enzymes, hemicelluloses, are a heterogeneous group of branched and linear polysaccharides that are bound via hydrogen bonds to the cellulose microfibrils in the plant cell wall, crosslinking them into a robust network. Hemicelluloses are also covalently attached to lignin, forming together with cellulose a highly complex structure. The variable structure and organization of hemicelluloses require the concerted action of many enzymes for its complete degradation. The catalytic modules of hemicellulases are either glycoside hydrolases (GHs) that hydrolyze glycosidic bonds, or carbohydrate esterases (CEs), which hydrolyze ester linkages of acetate or ferulic acid side groups. These catalytic modules, based on homology of their primary sequence, can be assigned into GH and CE families. Some families, with an overall similar fold, can be further grouped into clans, marked alphabetically (e.g., GH-A). A most informative and updated classification of these and other carbohydrate active enzymes is available in the Carbohydrate-Active Enzymes (CAZy) database. Hemicellulolytic enzyme activities can be measured according to Ghose and Bisaria, 1987, *Pure & Appl. Chem.* 59: 1739-1752, at a suitable temperature such as 40° C.-80° C., e.g., 50° C., 55° C., 60° C., 65° C., or 70° C., and a suitable pH such as 4-9, e.g., 5.0, 5.5, 6.0, 6.5, or 7.0.

Hybrid polypeptide: The term "hybrid polypeptide" means a polypeptide comprising domains from two or more polypeptides, e.g., a binding module from one polypeptide and a catalytic domain from another polypeptide. The domains may be fused at the N-terminus or the C-terminus.

Hybridization: The term "hybridization" means the pairing of substantially complementary strands of nucleic acids, using standard Southern blotting procedures. Hybridization may be performed under medium, medium-high, high or very high stringency conditions. Medium stringency conditions means prehybridization and hybridization at 42° C. in 5×SSPE, 0.3% SDS, 200 micrograms/ml sheared and denatured salmon sperm DNA, and 35% formamide for 12 to 24 hours, followed by washing three times each for 15 minutes using 0.2×SSC, 0.2% SDS at 55° C. Medium-high stringency conditions means prehybridization and hybridization at 42° C. in 5×SSPE, 0.3% SDS, 200 micrograms/ml sheared and denatured salmon sperm DNA, and 35% formamide for 12 to 24 hours, followed by washing three times each for 15 minutes using 0.2×SSC, 0.2% SDS at 60° C. High stringency conditions means prehybridization and hybridization at 42° C. in 5×SSPE, 0.3% SDS, 200 micrograms/ml sheared and denatured salmon sperm DNA, and 50% formamide for 12 to 24 hours, followed by washing three times each for 15 minutes using 0.2×SSC, 0.2% SDS at 65° C. Very high stringency conditions means prehybridization and hybridization at 42° C. in 5×SSPE, 0.3% SDS, 200 micrograms/ml sheared and denatured salmon sperm DNA, and 50% formamide for 12 to 24 hours, followed by washing three times each for 15 minutes using 0.2×SSC, 0.2% SDS at 70° C.

Isolated: The term "isolated" means a substance in a form or environment that does not occur in nature. Non-limiting examples of isolated substances include (1) any non-naturally occurring substance, (2) any substance including, but not limited to, any enzyme, variant, nucleic acid, protein, peptide or cofactor, that is at least partially removed from one or more or all of the naturally occurring constituents with which it is associated in nature; (3) any substance modified by the hand of man relative to that substance found in nature; or (4) any substance modified by increasing the amount of the substance relative to other components with which it is naturally associated (e.g., recombinant production in a host cell; multiple copies of a gene encoding the substance; and use of a stronger promoter than the promoter naturally associated with the gene encoding the substance). A fermentation broth produced by culturing a recombinant host cell expressing the polynucleotide of the invention will comprise the polypeptide of the invention in an isolated form.

Mature polypeptide: The term "mature polypeptide" means a polypeptide in its mature form following N-terminal processing (e.g., removal of signal peptide). In one aspect, the mature polypeptide is amino acids 20 to 370 of SEQ ID NO: 2. In one aspect, the mature polypeptide is SEQ ID NO: 3. In another aspect, the mature polypeptide is amino acids 19 to 369 of SEQ ID NO: 5. In one aspect, the mature polypeptide is SEQ ID NO: 6. In another aspect, the mature polypeptide is amino acids 21 to 378 of SEQ ID NO: 8. In one aspect, the mature polypeptide is SEQ ID NO: 9. In another aspect, the mature polypeptide is amino acids 21 to 363 of SEQ ID NO: 11. In one aspect, the mature polypeptide is SEQ ID NO: 12. In another aspect the mature polypeptide is amino acids 23 to 436 of SEQ ID NO: 14. In one aspect, the mature polypeptide is SEQ ID NO: 15. In another aspect, the mature polypeptide is amino acids 21 to 380 of SEQ ID NO: 17. In one aspect, the mature polypeptide is SEQ ID NO: 18. In another aspect, the mature polypeptide is amino acids 21 to 446 of SEQ ID NO: 20. In one aspect, the mature polypeptide is SEQ ID NO: 21. In another aspect, the mature polypeptide is amino acids 20 to 384 of SEQ ID NO: 23. In one aspect, the mature polypeptide is SEQ ID NO: 24. In another aspect the mature polypeptide is amino acids 21 to 370 of SEQ ID NO: 26. In one aspect, the mature polypeptide is SEQ ID NO: 27. In another aspect the mature polypeptide is amino acids 18 to 496 of SEQ ID NO: 29. In one aspect, the mature polypeptide is SEQ ID NO: 30. In another aspect, the mature polypeptide is amino acids 19 to 491 of SEQ ID NO: 32. In one aspect, the mature polypeptide is SEQ ID NO: 33. In another aspect, the mature polypeptide is amino acids 20 to 370 of SEQ ID NO: 35. In one aspect, the mature polypeptide is SEQ ID NO: 36. In another aspect, the mature polypeptide is amino acids 22 to 369 of SEQ ID NO: 38. In one aspect, the mature polypeptide is SEQ ID NO: 39. In another aspect, the mature polypeptide is amino acids 22 to 362 of SEQ ID NO: 41. In one aspect, the mature polypeptide is SEQ ID NO: 42. In another aspect, the mature polypeptide is amino acids 18 to 368 of SEQ ID NO: 44. In one aspect, the mature polypeptide is SEQ ID NO: 45. In another aspect, the mature polypeptide is amino acids 25 to 429 of SEQ ID NO: 47. In one aspect, the mature polypeptide is SEQ ID NO: 48. In another aspect, the mature polypeptide is amino acids 19 to 440 of SEQ ID NO: 50. In one aspect, the mature polypeptide is SEQ ID NO: 51. In another aspect, the mature polypeptide is amino acids 23 to 475 of SEQ ID NO: 53. In one aspect, the mature polypeptide is SEQ ID NO: 54. In another aspect, the mature polypeptide is amino acids 17 to 469 of SEQ ID NO: 56. In one aspect, the mature polypeptide is SEQ ID NO: 57. In another aspect, the mature polypeptide is amino acids 16 to 454 of SEQ ID NO: 59. In one aspect, the mature polypeptide is SEQ ID NO: 60. In another aspect, the mature polypeptide is amino acids 21 to 423 of SEQ ID NO: 62. In one aspect, the mature polypeptide is SEQ ID NO: 63. In another aspect, the mature polypeptide is amino acids 18 to 331 of SEQ ID NO: 65. In one aspect, the mature polypeptide is SEQ ID NO: 66. In another aspect, the mature polypeptide is amino acids 20 to 399 of SEQ ID NO: 68. In one aspect, the mature polypeptide is SEQ ID NO: 69. In another aspect, the mature polypeptide is amino acids 19 to 396 of SEQ ID NO: 71. In one aspect, the mature polypeptide is SEQ ID NO: 72. In another aspect, the mature polypeptide is amino acids 19 to 396 of SEQ ID NO: 74. In one aspect, the mature polypeptide is SEQ ID NO: 75. In another aspect, the mature polypeptide is amino acids 21 to 378 of SEQ ID NO: 77. In another aspect, the mature polypeptide is SEQ ID NO: 78. In another aspect, the mature polypeptide is amino acids 21 to 379 of SEQ ID NO: 80. In another aspect, the mature polypeptide is SEQ ID NO: 81. In another aspect, the mature polypeptide is amino acids 19 to 253 of SEQ ID NO: 83. In another aspect, the mature polypeptide is SEQ ID NO: 84. In another aspect, the mature polypeptide is amino acids 18 to 250 of SEQ ID NO: 86. In another aspect, the mature polypeptide is SEQ ID NO: 87. In another aspect, the mature polypeptide is amino acids 19 to 340 of SEQ ID NO: 89. In another aspect, the mature polypeptide is SEQ ID NO: 90. In another aspect, the mature polypeptide is amino acids 23 to 256 of SEQ ID NO: 92. In another aspect, the mature polypeptide is SEQ ID NO: 93. In another aspect, the mature polypeptide is amino acids 21 to 528 of SEQ ID NO: 95. In another aspect, the mature polypeptide is SEQ ID NO: 96. In another aspect, the mature polypeptide is amino acids 22 to 663 of SEQ ID NO: 98. In another aspect, the mature polypeptide is SEQ ID NO: 99. In another aspect, the mature polypeptide is amino acids 20 to 527 of SEQ ID NO: 101. In another aspect, the mature polypeptide is SEQ ID NO: 102. In another aspect, the mature polypeptide is amino acids 17 to 350 of SEQ ID NO: 104. In another aspect, the mature polypeptide is SEQ ID NO: 105. In another aspect, the mature polypeptide is amino acids 21 to 379 of SEQ ID NO: 107. In another aspect, the mature polypeptide is SEQ ID NO: 108. In another aspect, the mature polypeptide is amino acids 20 to 467 of SEQ ID NO: 134. In another aspect, the mature polypeptide is SEQ ID NO: 135. In another aspect, the mature polypeptide is amino acids 24 to 592 of SEQ ID NO: 137. In another aspect, the mature polypeptide is SEQ ID NO: 138. In another aspect, the mature polypeptide is amino acids 20 to 546 of SEQ ID NO: 140. In another aspect, the mature polypeptide is SEQ ID NO: 141. In another aspect, the mature polypeptide is amino acids 21 to 380 of SEQ ID NO: 143. In another aspect, the mature polypeptide is SEQ ID NO: 144. In another aspect, the mature polypeptide is amino acids 20 to 470 of SEQ ID NO: 146. In another aspect, the mature polypeptide is SEQ ID NO: 147.

It is known in the art that a host cell may produce a mixture of two of more different mature polypeptides (i.e., with a different C-terminal and/or N-terminal amino acid) expressed by the same polynucleotide. It is also known in the art that different host cells process polypeptides differently, and thus, one host cell expressing a polynucleotide may produce a different mature polypeptide (e.g., having a different C-terminal and/or N-terminal amino acid) as compared to another host cell expressing the same polynucleotide.

Mature polypeptide coding sequence: The term "mature polypeptide coding sequence" means a polynucleotide that encodes a mature polypeptide having pectinase activity. In one aspect, the mature polypeptide coding sequence is nucleotides 1 to 1110 of SEQ ID NO: 1. In one aspect, the mature polypeptide coding sequence is nucleotides 1 to 231 and 282 to 1160 of SEQ ID NO: 4, or the cDNA sequence thereof. In one aspect, the mature polypeptide coding sequence is nucleotides 1 to 261, 355 to 777, 847 to 976, and 1148 to 1470 of SEQ ID NO: 7, or the cDNA sequence thereof. In one aspect, the mature polypeptide coding sequence is nucleotides 1 to 216, 269 to 685 and 744 to 1202 of SEQ ID NO: 10, or the cDNA sequence thereof. In one aspect, the mature polypeptide coding sequence is nucleotides 1 to 307, 402 to 771, 830 to 888, 957 to 1117, 1186 to 1374, 1449 to 1550, 1616 to 1690 and 1751 to 1798 of SEQ ID NO: 13, or the cDNA sequence thereof. In one aspect, the mature polypeptide coding sequence is nucleotides 1 to 267, 326 to 748, 826 to 955 and 1014 to 1336 of SEQ ID NO: 16, or the cDNA sequence thereof. In one aspect, the mature polypeptide coding sequence is nucleotides 1 to 351, 416 to 583, 637 to 810, 856 to 1101 and 1151 to 1552 of SEQ ID NO: 19, or the cDNA sequence thereof. In one aspect, the mature polypeptide coding sequence is nucleotides 1 to 1155 of SEQ ID NO: 22. In one aspect, the mature polypeptide coding sequence is nucleotides 1 to 234, 287 to 706 and 768 to 1226 of SEQ ID NO: 25, or the cDNA sequence thereof. In one aspect, the mature polypeptide coding sequence is nucleotides 1 to 300, 352 to 660, 714 to 859, 918 to 1371 and 1449 to 1730 of SEQ ID NO: 28, or the cDNA sequence thereof. In one aspect, the mature polypeptide coding sequence is nucleotides 1 to 1476 of SEQ ID NO: 31. In one aspect, the mature polypeptide coding sequence is nucleotides 1 to 228 and 276 to 1160 of SEQ ID NO: 34, or the cDNA sequence thereof. In one aspect, the mature polypeptide coding sequence is nucleotides 1 to 231, 327 to 746 and 847 to 1305 of SEQ ID NO: 37, or the cDNA sequence thereof. In one aspect, the mature polypeptide coding sequence is nucleotides 1 to 630 and 700 to 1158 of SEQ ID NO: 40, or the cDNA sequence thereof. In one aspect, the mature polypeptide coding sequence is nucleotides 1 to 228, 280 to 699 and 750 to 1208 of SEQ ID NO: 43, or the cDNA sequence thereof. In one aspect, the mature polypeptide coding sequence is nucleotides 1 to 282, 350 to 716, 776 to 975 and 1064 to 1504 of SEQ ID NO: 46, or the cDNA sequence thereof. In one aspect, the mature polypeptide coding sequence is nucleotides 1 to 624, 689 to 727, 792 to 993 and 1060 to 1517 of SEQ ID NO: 49, or the cDNA sequence thereof. In one aspect, the mature polypeptide coding sequence is nucleotides 1 to 1428 of SEQ ID NO: 52. In one aspect, the mature polypeptide coding sequence is nucleotides 1 to 1410 of SEQ ID NO: 55. In one aspect, the mature polypeptide coding sequence is nucleotides 1 to 1134 and 1186 to 1416 of SEQ ID NO: 58, or the cDNA sequence thereof. In one aspect, the mature polypeptide coding sequence is nucleotides 1 to 264, 319 to 685, 746 to 945 and 997 to 1437 of SEQ ID NO: 61, or the cDNA sequence thereof. In one aspect, the mature polypeptide coding sequence is nucleotides 1 to 993 of SEQ ID NO: 64. In one aspect, the mature polypeptide coding sequence is nucleotides 1 to 645 and 696 to 1250 of SEQ ID NO: 67, or the cDNA sequence thereof. In one aspect, the mature polypeptide coding sequence is nucleotides 1 to 633 and 690 to 1247 of SEQ ID NO: 70, or the cDNA sequence thereof. In one aspect, the mature polypeptide coding sequence is nucleotides 1 to 633 and 689 to 1246 of SEQ ID NO: 73, or the cDNA sequence thereof. In one aspect, the mature polypeptide coding sequence is nucleotides 1 to 723 and 780 to 1193 of SEQ ID NO: 76, or the cDNA sequence thereof. In one aspect, the mature polypeptide coding sequence is nucleotides 1 to 203, 266 to 409, 467 to 592, 649 to 979 and 1036 to 1371 of SEQ ID NO: 79, or the cDNA sequence thereof. In one aspect, the mature polypeptide coding sequence is nucleotides 1 to 288, 370 to 474 and 572 to 940 of SEQ ID NO: 82, or the cDNA sequence thereof. In one aspect, the mature polypeptide coding sequence is nucleotides 1 to 753 of SEQ ID NO: 85. In one aspect, the mature polypeptide coding sequence is nucleotides 1 to 1020 of SEQ ID NO: 88. In one aspect, the mature polypeptide coding sequence is nucleotides 1 to 417 and 472 to 825 of SEQ ID NO: 91, or the cDNA sequence thereof. In one aspect, the mature polypeptide coding sequence is nucleotides 1 to 256, 312 to 413, 474 to 595, 651 to 720, 769 to 844, 892 to 943, 995 to 1206, 1257 to 1478, 1551 to 1797, 1870 to 2010, 2073 to 2129 and 2204 to 2233 of SEQ ID NO: 94, or the cDNA sequence thereof. In one aspect, the mature polypeptide coding sequence is nucleotides 1 to 1992 of SEQ ID NO: 97. In one aspect, the mature polypeptide coding sequence is nucleotides 1 to 1584 of SEQ ID NO: 100. In one aspect, the mature polypeptide coding sequence is nucleotides 1 to 324 and 395 to 1123 of SEQ ID NO: 103, or the cDNA sequence thereof. In one aspect, the mature polypeptide coding sequence is nucleotides 61 to 1140 of SEQ ID NO: 106. In one aspect, the mature polypeptide coding sequence is nucleotides 171 to 630, 796 to 834, 889 to 1090, and 1158 to 1690 of SEQ ID NO: 133, or the cDNA sequence thereof. In one aspect, the mature polypeptide coding sequence is nucleotides 207 to 226, 295 to 911, and 975 to 1880 of SEQ ID NO: 136. In one aspect, the mature polypeptide coding sequence is nucleotides 61 to 618, 669 to 856, 914 to 1559, and 1608 to 1796 of SEQ ID NO: 139. In one aspect, the mature polypeptide coding sequence is nucleotides 61 to 261, 328 to 750, 806 to 935, and 1010 to 1338 of SEQ ID NO: 142. In one aspect, the mature polypeptide coding sequence is nucleotides 58 to 1413 of SEQ ID NO: 145.

Native: The term "native" means a nucleic acid or polypeptide naturally occurring in a host cell.

Nucleic acid construct: The term "nucleic acid construct" means a nucleic acid molecule, either single- or double-stranded, which is isolated from a naturally occurring gene or is modified to contain segments of nucleic acids in a manner that would not otherwise exist in nature or which is synthetic, which comprises one or more control sequences.

Operably linked: The term "operably linked" means a configuration in which a control sequence is placed at an appropriate position relative to the coding sequence of a polynucleotide such that the control sequence directs expression of the coding sequence.

Pectinase: The term "pectinase" is defined as a broad class of enzymes, which catalyzes hydrolysis of pectin, a structural plant cell wall acidic heteropolysaccharide with a backbone that contains 1,4-linked alpha-D-galactosyluronic acid residues. What follows is a definition of different classes of pectinases of the present invention. Activity units are defined for each of the pectinase classes. The skilled artisan can readily determine whether a polypeptide has a particular type of pectinase activity using the definitions and activity units below.

Polygalacturonase: The term "polygalacturonase" (1,4-alpha-D-galacturonan glucanohydrolase, EC 3.2.1.15 and EC 3.2.1.67) is defined as an enzyme, which catalyzes the hydrolysis of 1,4-alpha-D-galactosiduronic linkages in pectate and other galacturonans. Polygalacturonases are classified as either endo-polygalacturonases or exo-polygalacturonases. Endo-polygalacturonases (EC 3.2.1.15) catalyze the random cleavage of pectic acid, whereas exo-polygalacturonases (EC 3.2.1.67) catalyze the cleavage of pectic acid in a sequential manner on non-reducing ends of pectic acid producing either mono-galacturonate or di-galacturonate. Classes of polygalacturonases are differentiated by their characteristic amino acid sequences with commonly conserved, functional domain motifs known as SPNTDG (PG I), GDDC (PG II), CGPGHGISIGSLG (PG III), and RIK (PG IV). The polygalacturonase unit (PGU) is defined as the amount of enzyme, which will liberate 1.0 micromole galacturonic acid from poly-galacturonic acid per hour under the standard conditions pH 4.0, 25° C. (Kertesz, Z. I. (1955) Methods in Enzymology. 1, 162-164).

Rhamnogalacturonanase: The term "rhamnogalacturonanase" (rhamnogalacturonan alpha-D-galacturonic acid-1,2-alpha-L-rhamnose hydrolase, EC 3.2.1.171) is defined as an enzyme, which catalyzes the endohydrolysis of alpha-D-galacturonic acid-1,2-alpha-L-rhamnose glycosidic bond in the rhamnogalacturonan backbone with initial inversion of anomeric configuration releasing oligosaccharides with beta-D-galacturonic acid at the reducing end. Classes of rhamnogalacturonanases are differentiated by their specificity toward rhamnogalacturonan I (RG I) pectic heteropolysaccharides or rhamnogalacturonan II (RG II) pectic heteropolysaccharides. The rhamnogalacturonase activity unit (RGU) is defined as the amount of dye released, as measured by the absorbance change, from a solution of 20 mg/mL AZ-rhamnogalacturonan per mg enzyme per minute under standard reaction conditions pH 4.5, 40° C., buffer: 25 mM sodium acetate, reaction time: 16 hours (de Vries, R. P. (2015) Biotechnology for Biofuels. 8:107).

Pectin Methyl Esterase: The term "pectin methylesterase" (pectin pectyl hydrolase, EC 3.1.1.11) is defined as an enzyme, which catalyzes demethoxylation of methyl ester groups in pectin chains to form pectate and releasing methanol. The pectinesterase unit (PMU) is defined as the amount of methanol liberated from a 1.0% solution of pectin containing 0.1 M sodium chloride in 30 minutes per gram of enzyme under the standard conditions pH 7.5, 30° C. (Kertesz, Z. I. (1955) Methods in Enzymology. 1, 162-164).

Pectin Lyase: The term "pectin lyase" ((1,4)-6-O-methyl-alpha-D-galacturonan lyase, EC 4.2.2.10) is defined as an enzyme, which catalyzes the eliminative cleavage of 1,4-alpha-D-galacturonan methyl esters to oligosaccharides with 4-deoxy-6-O-methyl-alpha-D-galact-4-enuronosyl groups at the non-reducing ends. The pectin lyase unit (PLU) is defined as the amount of enzyme, which will result in a change in absorbance of 1.0 at 235 nm in a solution of 0.5% w/v pectin under the standard conditions of pH 6.0, 40° C., reaction buffer: 100 mM citric acid, 100 mM sodium phosphate, reaction time: 5 minutes (Albersheim, P. (1966) Methods in Enzymology, Vol. 8, 628-631).

Pectin Acetyl Esterase: The term "pectin acetylesterase" (acetic ester acetylhydrolase, EC 3.1.1.6) is defined as an enzyme, which catalyzes deacetylation of acetyl ester groups in pectin chains to form pectate and releasing acetic acid. The pectin acetylesterase activity unit is defined as the amount of p-nitrophenol in mmol as measured by absorbance at 460 nm released from a 2 mM solution of p-nitrophenol-acetyl by 1 mg of enzyme in 1 minute under standard assay conditions pH 7.4, 37° C., reaction buffer: 25 mm Tris-HCl, 50 mm EDTA, and 150 mm $MgCl_2$, reaction time: 1 minute (Pogorelko, G. (2013) BIOCHEMISTRY AND METABOLISM. 162: 9-23).

Rhamnogalacturonan Lyase: The term "rhamnogalacturonan lyase" (alpha-L-rhamnopyranosyl-1,4-alpha-D-galactopyranosyluronate endolyase, EC 4.2.2.23) is defined as an enzyme, which catalyzes endotype eliminative cleavage of L-alpha-rhamnopyranosyl-1,4-alpha-D-galactopyranosyluronic acid bonds of rhamnogalacturonan leaving L-rhamnopyranose at the reducing end and 4-deoxy-4,5-unsaturated D-galactopyranosyluronic acid at the non-reducing end. The rhamnogalacturonan lyase unit activity is defined as the amount of enzyme that produces 1 μmol of oligogalacturonides per minute, equivalent to the absorbance of 1 μmol unsaturated digalacturonide, using a molecular extinction coefficient for the dimer of 4600 $M^{-1}$ $cm^{-1}$ at 235 nm from rhamnogalacturonan under standard reaction conditions of pH 9.0, 37° C., reaction buffer: 25 mM Tris/HCl, 25 mM glycine/NaOH, reaction time: 5 minutes.

Beta-Galactanase: The term "beta-galactanase" (galactan endo-beta-1,3-galactanase, EC 3.2.1.181) is defined as an enzyme, which catalyzes the endohydrolysis of beta-1,3 bonds in arabinogalactan requiring at least three continuous beta-1,3-residues. The beta-galactanase activity unit is defined as the amount of enzyme that releases 1 μmol of galactose from a 1% solution of beta-galactan per minute under standard reaction conditions pH 4.0, 37° C., reaction buffer: 100 mM sodium acetate/acetic acid with 0.2% bovine serum albumin, reaction time: 4 hours (Carey, A. T. (1995) Plant Physiol. 108: 1099-1107).

Protease: The term "protease" is defined herein as an enzyme that hydrolyses peptide bonds. It includes any enzyme belonging to the EC 3.4 enzyme group (including each of the thirteen subclasses thereof). The EC number refers to Enzyme Nomenclature 1992 from NC-IUBMB, Academic Press, San Diego, California, including supplements 1-5 published in *Eur. J. Biochem.* 223: 1-5 (1994); *Eur. J. Biochem.* 232: 1-6 (1995); *Eur. J. Biochem.* 237: 1-5 (1996); *Eur. J. Biochem.* 250: 1-6 (1997); and *Eur. J. Biochem.* 264: 610-650 (1999); respectively. The term "subtilases" refer to a sub-group of serine protease according to Siezen et al., 1991, *Protein Engng.* 4: 719-737 and Siezen et al., 1997, *Protein Science* 6: 501-523.

Proteases are classified on the basis of their catalytic mechanism into the following groups: Serine proteases (S), Cysteine proteases (C), Aspartic proteases (A), Metalloproteases (M), and Unknown, or as yet unclassified, proteases (U), see Handbook of Proteolytic Enzymes, A. J. Barrett, N. D. Rawlings, J. F. Woessner (eds), Academic Press (1998), in particular the general introduction part.

Polypeptides having protease activity, or proteases, are sometimes also designated peptidases, proteinases, peptide hydrolases, or proteolytic enzymes. Proteases may be of the exo-type (exopeptidases) that hydrolyse peptides starting at either end thereof, or of the endotype that act internally in polypeptide chains (endopeptidases).

In particular embodiments, the proteases for use in the processes of the invention are selected from the group consisting of:

(a) proteases belonging to the EC 3.4.24 metalloendopeptidases;
(b) metalloproteases belonging to the M group of the above Handbook;
(c) metalloproteases not yet assigned to clans (designation: Clan MX), or belonging to either one of clans MA, MB, MC, MD, ME, MF, MG, MH (as defined at pp. 989-991 of the above Handbook);
(d) other families of metalloproteases (as defined at pp. 1448-1452 of the above Handbook);
(e) metalloproteases with a HEXXH motif;
(f) metalloproteases with an HEFTH motif;
(g) metalloproteases belonging to either one of families M3, M26, M27, M32, M34, M35, M36, M41, M43, or M47 (as defined at pp. 1448-1452 of the above Handbook); and
(h) metalloproteases belonging to family M35 (as defined at pp. 1492-1495 of the above Handbook).

Protease activity: The term "protease activity" means proteolytic activity (EC 3.4). There are several protease activity types such as trypsin-like proteases cleaving at the carboxyterminal side of Arg and Lys residues and chymotrypsin-like proteases cleaving at the carboxyterminal side of hydrophobic amino acid residues.

Protease activity can be measured using any assay, in which a substrate is employed, that includes peptide bonds relevant for the specificity of the protease in question. Assay-pH and assay-temperature are likewise to be adapted to the protease in question. Examples of assay-pH-values are pH 2, 3, 4, 5, 6, 7, 8, 9, 10, 11, or 12. Examples of assay-temperatures are 15, 20, 25, 30, 35, 37, 40, 45, 50, 55, 60, 65, 70, 80, 90, or 95° C. Examples of general protease substrates are casein, bovine serum albumin and haemoglobin. In the classical Anson and Mirsky method, denatured haemoglobin is used as substrate and after the assay incubation with the protease in question, the amount of trichloroacetic acid soluble haemoglobin is determined as a measurement of protease activity (Anson, M. L. and Mirsky, A. E., 1932, *J. Gen. Physiol.* 16: 59 and Anson, M. L., 1938, *J. Gen. Physiol.* 22: 79).

Purified: The term "purified" means a nucleic acid or polypeptide that is substantially free from other components as determined by analytical techniques well known in the art (e.g., a purified polypeptide or nucleic acid may form a discrete band in an electrophoretic gel, chromatographic eluate, and/or a media subjected to density gradient centrifugation). A purified nucleic acid or polypeptide is at least about 50% pure, usually at least about 60%, about 65%, about 70%, about 75%, about 80%, about 85%, about 90%, about 91%, about 92%, about 93%, about 94%, about 95%, about 96%, about 97%, about 98%, about 99%, about 99.5%, about 99.6%, about 99.7%, about 99.8% or more pure (e.g., percent by weight on a molar basis). In a related sense, a composition is enriched for a molecule when there is a substantial increase in the concentration of the molecule after application of a purification or enrichment technique. The term "enriched" refers to a compound, polypeptide, cell, nucleic acid, amino acid, or other specified material or component that is present in a composition at a relative or absolute concentration that is higher than a starting composition.

Recombinant: The term "recombinant," when used in reference to a cell, nucleic acid, protein or vector, means that it has been modified from its native state. Thus, for example, recombinant cells express genes that are not found within the native (non-recombinant) form of the cell, or express native genes at different levels or under different conditions than found in nature. Recombinant nucleic acids differ from a native sequence by one or more nucleotides and/or are operably linked to heterologous sequences, e.g., a heterologous promoter in an expression vector. Recombinant proteins may differ from a native sequence by one or more amino acids and/or are fused with heterologous sequences. A vector comprising a nucleic acid encoding a polypeptide is a recombinant vector. The term "recombinant" is synonymous with "genetically modified" and "transgenic".

Sequence identity: The relatedness between two amino acid sequences or between two nucleotide sequences is described by the parameter "sequence identity". For purposes of the present invention, the sequence identity between two amino acid sequences is determined using the Needleman-Wunsch algorithm (Needleman and Wunsch, 1970, *J. Mol. Biol.* 48: 443-453) as implemented in the Needle program of the EMBOSS package (EMBOSS: The European Molecular Biology Open Software Suite, Rice et al., 2000, *Trends Genet.* 16: 276-277), preferably version 5.0.0 or later. The parameters used are gap open penalty of 10, gap extension penalty of 0.5, and the EBLOSUM62 (EMBOSS version of BLOSUM62) substitution matrix. The output of Needle labeled "longest identity" (obtained using the—nobrief option) is used as the percent identity and is calculated as follows:

$$(\text{Identical Residues}\times 100)/(\text{Length of Alignment}-\text{Total Number of Gaps in Alignment})$$

For purposes of the present invention, the sequence identity between two deoxyribonucleotide sequences is determined using the Needleman-Wunsch algorithm (Needleman and Wunsch, 1970, supra) as implemented in the Needle program of the EMBOSS package (EMBOSS: The European Molecular Biology Open Software Suite, Rice et al., 2000, supra), preferably version 5.0.0 or later. The parameters used are gap open penalty of 10, gap extension penalty of 0.5, and the EDNAFULL (EMBOSS version of NCBI NUC4.4) substitution matrix. The output of Needle labeled "longest identity" (obtained using the—nobrief option) is used as the percent identity and is calculated as follows:

(Identical Deoxyribonucleotides×100)/(Length of Alignment−Total Number of Gaps in Alignment)

Subsequence: The term "subsequence" means a polynucleotide having one or more (e.g., several) nucleotides absent from the 5' and/or 3' end of a mature polypeptide coding sequence; wherein the subsequence encodes a fragment having pectinase activity.

Trehalase: The term "trehalase" means an enzyme which degrades trehalose into its unit monosaccharides (i.e., glucose). Trehalases are classified in EC 3.2.1.28 (alpha, alpha-trehalase) and EC. 3.2.1.93 (alpha, alpha-phosphotrehalase). The EC classes are based on recommendations of the Nomenclature Committee of the International Union of Biochemistry and Molecular Biology (IUBMB). Description of EC classes can be found on the internet at the Expasy website. Trehalases are enzymes that catalyze the following reactions:

EC 3.2.1.28:

Alpha,alpha-trehalose+$H_2O$⇔2D-glucose;

EC 3.2.1.93:

Alpha,alpha-trehalose 6-phosphate+$H_2O$⇔D-glucose+D-glucose 6-phosphate.

For purposes of the present invention, trehalase activity may be determined according to the trehalase assay procedure described below.

Principle:

Trehalose+$H_2O \xrightarrow{Trehalase}$2Glucose

T=37° C., pH=5.7, A340 nm, Light path=1 cm

Spectrophotometric Stop Rate Determination

Unit Definition:

One unit will convert 1.0 mmole of trehalose to 2.0 mmoles of glucose per minute at pH 5.7 at 37° C. (liberated glucose determined at pH 7.5).

(See Dahlqvist, A. (1968) Analytical Biochemistry 22, 99-107)

Variant: The term "variant" means a polypeptide having pectinase activity) comprising a man-made mutation, i.e., a substitution, insertion, and/or deletion (e.g., truncation), at one or more (e.g., several) positions. A substitution means replacement of the amino acid occupying a position with a different amino acid; a deletion means removal of the amino acid occupying a position; and an insertion means adding an amino acid adjacent to and immediately following the amino acid occupying a position. In some embodiments, insertion means adding one or more (e.g., several) amino acids, e.g., 1-5 amino acids, adjacent to the amino acid occupying a position). The variants of the present invention have at least 20%, e.g., at least 40%, at least 50%, at least 60%, at least 70%, at least 80%, at least 90%, at least 95%, or at least 100% of the pectinase activity of the polypeptide of sequence selected from the group consisting of: SEQ ID NO: 3, SEQ ID NO: 6, SEQ ID NO: 9, SEQ ID NO: 12, SEQ ID NO: 15, SEQ ID NO: 18, SEQ ID NO: 21, SEQ ID NO: 24, SEQ ID NO: 27, SEQ ID NO: 30, SEQ ID NO: 33, SEQ ID NO: 36, SEQ ID NO: 39, SEQ ID NO: 42, SEQ ID NO: 45, SEQ ID NO: 48, SEQ ID NO: 51, SEQ ID NO: 54, SEQ ID NO: 57, SEQ ID NO; 60, SEQ ID NO: 63, SEQ ID NO: 66, SEQ ID NO: 69, SEQ ID NO: 72, SEQ ID NO: 75, SEQ ID NO: 78, SEQ ID NO: 81, SEQ ID NO: 84, SEQ ID NO: 87, SEQ ID NO: 90, SEQ ID NO: 93, SEQ ID NO: 96, SEQ ID NO: 99, SEQ ID NO: 102, or SEQ ID NO: 105 or the mature polypeptide of a sequence of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO; 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 95, SEQ ID NO: 98, SEQ ID NO: 101, SEQ ID NO: 104, SEQ ID NO: 107, SEQ ID NO: 134, SEQ ID NO: 137, SEQ ID NO: 140, SEQ ID NO: 143, or SEQ ID NO: 146.

Wild-type: The term "wild-type" in reference to an amino acid sequence or nucleic acid sequence means that the amino acid sequence or nucleic acid sequence is a native or naturally-occurring sequence. As used herein, the term "naturally-occurring" refers to anything (e.g., proteins, amino acids, or nucleic acid sequences) that is found in nature. Conversely, the term "non-naturally occurring" refers to anything that is not found in nature (e.g., recombinant nucleic acids and protein sequences produced in the laboratory or modification of the wild-type sequence). The term "wild-type" pectinase means a pectinase expressed by a naturally occurring microorganism, such as a bacterium, yeast, or filamentous fungus found in nature.

Xylanase: The term "xylanase" means a 1,4-beta-D-xylan-xylohydrolase (E.C. 3.2.1.8) that catalyzes the endohydrolysis of 1,4-beta-D-xylosidic linkages in xylans. Xylanase activity can be determined with 0.2% AZCL-arabinoxylan as substrate in 0.01% TRITON® X-100 and 200 mM sodium phosphate pH 6 at 37° C. One unit of xylanase activity is defined as 1.0 μmole of azurine produced per minute at 37° C., pH 6 from 0.2% AZCL-arabinoxylan as substrate in 200 mM sodium phosphate pH 6.

Reference to "about" a value or parameter herein includes embodiments that are directed to that value or parameter per se. For example, description referring to "about X" includes the embodiment "X". When used in combination with measured values, "about" includes a range that encompasses at least the uncertainty associated with the method of measuring the particular value, and can include a range of plus or minus two standard deviations around the stated value.

Likewise, reference to a gene or polypeptide that is "derived from" another gene or polypeptide X, includes the gene or polypeptide X.

As used herein and in the appended claims, the singular forms "a," "or," and "the" include plural referents unless the context clearly dictates otherwise.

It is understood that the embodiments described herein include "consisting" and/or "consisting essentially of" embodiments. As used herein, except where the context requires otherwise due to express language or necessary implication, the word "comprise" or variations such as "comprises" or "comprising" is used in an inclusive sense, i.e. to specify the presence of the stated features but not to preclude the presence or addition of further features in various embodiments.

DETAILED DESCRIPTION OF THE INVENTION

The genome of *Trichoderma reesei* is known to encode a diverse variety of plant cell wall degrading enzymes including cellulases, xylanases, xyloglucanases, galactomannanases, and even some inulinanase and amylase enzymes, but in comparison encode only a very small handful of pectin-degrading enzymes. During degradation of cellulosic fiber, particularly with progressive-acting cellulases such as cellobiohydrolyase I or cellulobiohydrolyase II, cross linkages of xyloglucan or pectin to or near the cellulose fiber surface may sterically hinder cellulolytic degradation and decrease accessibility to the cellulose fiber. As the second most abundant polysaccharide in grass cell walls is hemicellulose, specifically arabinoxylan, it has been previously demonstrated that degradation of the hemicellulose does increase cellulase accessibility to the cellulose fiber. However, the use of pectinolytic enzymes to degrade the pectin structures in corn kernel cell walls to increase cellulase accessibility to the cellulose fiber has not been previously demonstrated or described.

Recovery and elucidation of corn kernel cell wall pectin structures has not been well described in literature, and no complete models of complex pectin structures, such as rhamnogalacturonans existing corn kernel cell walls currently exist. The presently disclosed subject matter discloses multiple classes of pectinolytic enzymes which have been shown to degrade pectin in fiber (e.g., corn kernel cell walls) for the purpose of increasing cellulolytic enzyme accessibility to the cellulosic fiber. Work described herein demonstrates polygalacturonases and rhamnogalacturonases increase glucose recovery from hydrolysis of de-starched corn kernel fiber with a cellulolytic enzyme blend, indicating an increase in cellulosic fiber accessibility through degradation of complex pectic structures in the corn kernel cell walls, in addition to an increase in ethanol when added with a cellulolytic blend in SSF of a liquefied corn mash slurry. When both the polygalacturonase and rhamnogalacturonase were combined with a pectin methylesterase and/or acetyl methylesterase it was shown that the ethanol yield from SSF in the presence of a cellulolytic enzyme blend was even greater than when the polygalacturonase or rhamnogalacturonase was added alone. This indicates that the polygalacturonase and rhamnogalacturonase enzymes are inhibited by methyl ester and acetyl ester carboxyl groups on the pectin in corn kernel cell walls, and that by simultaneously demethylating or deacetylating the pectin during the SSF process the activity of the polygalacturonase or rhamnogalacturonase can be further improved.

Heterogalacturonan substitutions in pectin have been associated with arabinogalactan-pectin-arabinoxylan epitopes in some grass cell wall models and could be degraded by beta-galactanase enzymes. These structures have only been described in secondary plant cell walls but are still associated with the cellulose fiber in this layer. Rhamnogalacturonan lyase and pectin lyase may also play a role in pectin degradation in the plant cell wall during SSF with a cellulolytic enzyme blend, either alone or in conjunction with a polygalacturonase or rhamnogalacturonase. Work described herein unexpectedly further demonstrates that when used in conjunction with a polygalacturonase or rhamnogalacturonase enzyme, the rhamnogalacturonan lyase or pectin lyase may solubilize a portion of the pectin structure by randomly hydrolyzing the pectic structure into smaller oligosaccharides which would then be subjected to more complete degradation by the polygalacturonase or rhamnogalacturonase.

Polypeptides Having Pectinase Activity

In some embodiments, the present invention relates to isolated or purified polypeptides having a sequence identity of at least 99.6% identity, at least 99.7% identity, at least 99.8% or at least 99.9% identity, but less than 100% identity to the mature polypeptide of SEQ ID NO: 5, which have pectinase activity. In an aspect, the polypeptides differ by up to 10 amino acids, e.g., 1, 2, 3, 4, 5, 6, 7, 8, 9, or 10, from the mature polypeptide of SEQ ID NO: 5. The polypeptide preferably comprises, consists of, or consists essentially of the amino acid sequence of SEQ ID NO: 5 or the mature polypeptide thereof; or is a fragment thereof having pectinase activity. In one aspect, the mature polypeptide is amino acids 20 to 370 of SEQ ID NO: 5. In one aspect, the mature polypeptide is SEQ ID NO: 6.

In some embodiments, the present invention relates to isolated or purified polypeptides having a sequence identity of at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity, but less than 100% identity to the mature polypeptide of SEQ ID NO: 11, which have pectinase activity. In an aspect, the polypeptides differ by up to 10 amino acids, e.g., 1, 2, 3, 4, 5, 6, 7, 8, 9, or 10, from the mature polypeptide of SEQ ID NO: 11. The polypeptide preferably comprises, consists of, or consists essentially of the amino acid sequence of SEQ ID NO: 11 or the mature polypeptide thereof; or is a fragment thereof having pectinase activity. In one aspect, the mature polypeptide is amino acids 21 to 363 of SEQ ID NO: 11. In one aspect, the mature polypeptide is SEQ ID NO: 12.

In some embodiments, the present invention relates to isolated or purified polypeptides having a sequence identity of at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity, or 100% identity to the mature polypeptide of SEQ ID NO: 14, which have pectinase activity. In an aspect, the polypeptides differ by up to 10 amino acids, e.g., 1, 2, 3, 4, 5, 6, 7, 8, 9, or 10, from the mature polypeptide of SEQ ID NO: 14. The polypeptide preferably comprises, consists of, or consists essentially of the amino acid sequence of SEQ ID NO: 14 or the mature polypeptide thereof; or is a fragment thereof having pectinase activity. In one aspect, the mature polypeptide is amino acids 23 to 436 of SEQ ID NO: 14. In one aspect, the mature polypeptide is SEQ ID NO: 15.

In an embodiment, the present invention relates to isolated or purified polypeptides having a sequence identity of at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 17, which have pectinase activity. In an aspect, the polypeptides differ by up to 10 amino acids, e.g., 1, 2, 3, 4, 5, 6, 7, 8, 9, or 10, from the mature polypeptide of SEQ ID NO: 17. The polypeptide preferably comprises, consists of, or consists essentially of the amino acid sequence of SEQ ID NO: 17 or the mature polypeptide thereof, or is a fragment thereof having pectinase activity. In one aspect, the mature polypeptide is amino acids 21 to 380 of SEQ ID NO: 17. In another aspect, the mature polypeptide is SEQ ID NO: 18.

In an embodiment, the present invention relates to isolated or purified polypeptides having a sequence identity of at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 20, which have pectinase activity. In an embodiment, the polypeptides differ by up to 10 amino acids, e.g., 1, 2, 3, 4, 5, 6, 7, 8, 9, or 10, from the mature polypeptide of SEQ ID NO: 20. The polypeptide preferably comprises, consists of, or consists essentially of the amino acid sequence of SEQ ID NO: 20 or the mature polypeptide thereof, or is a fragment thereof having pectinase activity. In one aspect, the mature polypeptide is amino acids 21 to 446 of SEQ ID NO: 20. In another aspect, the mature polypeptide is SEQ ID NO: 21.

In an embodiment, the present invention relates to isolated or purified polypeptides having a sequence identity of at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 38, which have pectinase activity. In an embodiment, the polypeptides differ by up to 10 amino acids, e.g., 1, 2, 3, 4, 5, 6, 7, 8, 9, or 10, from the mature polypeptide of SEQ ID NO: 38. The polypeptide preferably comprises, consists of, or consists essentially of the amino acid sequence of SEQ ID NO: 38 or the mature polypeptide thereof, or is a fragment thereof having pectinase activity. In one aspect, the mature polypeptide is amino acids 22 to 369 of SEQ ID NO: 38. In another aspect, the mature polypeptide is SEQ ID NO: 39.

In an embodiment, the present invention relates to isolated or purified polypeptides having a sequence identity of at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 41, which have pectinase activity. In an embodiment, the polypeptides differ by up to 10 amino acids, e.g., 1, 2, 3, 4, 5, 6, 7, 8, 9, or 10, from the mature polypeptide of SEQ ID NO: 41. The polypeptide preferably comprises, consists of, or consists essentially of the amino acid sequence of SEQ ID NO: 41 or the mature polypeptide thereof, or is a fragment thereof having pectinase activity. In one aspect, the mature polypeptide is amino acids 22 to 362 of SEQ ID NO: 41. In another aspect, the mature polypeptide is SEQ ID NO: 42.

In an embodiment, the present invention relates to isolated or purified polypeptides having a sequence identity of at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 44, which have pectinase activity. In an embodiment, the polypeptides differ by up to 10 amino acids, e.g., 1, 2, 3, 4, 5, 6, 7, 8, 9, or 10, from the mature polypeptide of SEQ ID NO: 44. The polypeptide preferably comprises, consists of, or consists essentially of the amino acid sequence of SEQ ID NO: 44 or the mature polypeptide thereof, or is a fragment thereof having pectinase activity. In one aspect, the mature polypeptide is amino acids 18 to 368 of SEQ ID NO: 44. In another aspect, the mature polypeptide is SEQ ID NO: 45.

In an embodiment, the present invention relates to isolated or purified polypeptides having a sequence identity of at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 53, which have pectinase activity. In an embodiment, the polypeptide differs by up to 10 amino acids, e.g., 1, 2, 3, 4, 5, 6, 7, 8, 9, or 10, from the mature polypeptide of SEQ ID NO: 53. The polypeptide preferably comprises, consists of, or consists essentially of the amino acid sequence of SEQ ID NO: 53 or the mature polypeptide thereof, or is a fragment thereof having pectinase activity. In one aspect, the mature polypeptide is amino acids 23 to 475 of SEQ ID NO: 53. In another aspect, the mature polypeptide is SEQ ID NO: 54.

In an embodiment, the present invention relates to isolated or purified polypeptides having a sequence identity of at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 56, which have pectinase activity. In an embodiment, the polypeptide differs by up to 10 amino acids, e.g., 1, 2, 3, 4, 5, 6, 7, 8, 9, or 10, from the mature polypeptide of SEQ ID NO: 56. The polypeptide preferably comprises, consists of, or consists essentially of the amino acid sequence of SEQ ID NO: 56 or the mature polypeptide thereof, or is a fragment thereof having pectinase activity. In one aspect, the mature polypeptide is amino acids 17 to 469 of SEQ ID NO: 56. In another aspect, the mature polypeptide is SEQ ID NO: 57.

In an embodiment, the present invention relates to isolated or purified polypeptides having a sequence identity of at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO:

59, which have pectinase activity. In an embodiment, the polypeptide differs by up to 10 amino acids, e.g., 1, 2, 3, 4, 5, 6, 7, 8, 9, or 10, from the mature polypeptide of SEQ ID NO: 59. The polypeptide preferably comprises, consists of, or consists essentially of the amino acid sequence of SEQ ID NO: 59 or the mature polypeptide thereof, or is a fragment thereof having pectinase activity. In one aspect, the mature polypeptide is amino acids 16 to 454 of SEQ ID NO: 59. In another aspect, the mature polypeptide is SEQ ID NO: 60.

In an embodiment, the present invention relates to isolated or purified polypeptides having a sequence identity of at least 98% identity, at least 98.5% identity, at least 99% identity, at least 99.5% identity, at least 99.6% identity, at least 99.7% identity, at least 99.8% identity, or at least 99.9% identity to the mature polypeptide of SEQ ID NO: 62, which pectinase activity. In an embodiment, the polypeptides differ by up to 10 amino acids, e.g., 1, 2, 3, 4, 5, 6, 7, 8, 9, or 10, from the mature polypeptide of SEQ ID NO: 62. The polypeptide preferably comprises, consists of, or consists essentially of the amino acid sequence of SEQ ID NO: 62 or the mature polypeptide thereof, or is a fragment thereof having pectinase activity. In one aspect, the mature polypeptide is amino acids 21 to 423 of SEQ ID NO: 62. In another aspect, the mature polypeptide is SEQ ID NO: 63.

In an embodiment, the present invention relates to isolated or purified polypeptides having a sequence identity of at least 97% identity, at least 98% identity, or at least 99% identity to the mature polypeptide of SEQ ID NO: 68, which have pectinase activity. In an embodiment, the polypeptide differs by up to 10 amino acids, e.g., 1, 2, 3, 4, 5, 6, 7, 8, 9, or 10, from the mature polypeptide of SEQ ID NO: 68. In an embodiment, the polypeptide having pectinase activity comprises, consists of, or consists essentially of the amino acid sequence of SEQ ID NO: 68, or the mature polypeptide thereof, or is a fragment thereof having pectinase activity. In one aspect, the mature polypeptide is amino acids 20 to 399 of SEQ ID NO: 68. In another aspect, the mature polypeptide is SEQ ID NO: 69.

In an embodiment, the present invention relates to isolated or purified polypeptides having a sequence identity of at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 71, which have pectinase activity. In an embodiment, the polypeptide differs by up to 10 amino acids, e.g., 1, 2, 3, 4, 5, 6, 7, 8, 9, or 10, from the mature polypeptide of SEQ ID NO: 71. The polypeptide preferably comprises, consists of, or consists essentially of the mature polypeptide of SEQ ID NO: 71 or the mature polypeptide thereof, or is a fragment thereof having pectinase activity. In one aspect, the mature polypeptide is amino acids 19 to 396 of SEQ ID NO: 71. In another aspect, the mature polypeptide is SEQ ID NO: 72.

In an embodiment, the present invention relates to isolated or purified polypeptides having a sequence identity of at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 74, which have pectinase activity. In an embodiment, the polypeptide differs by up to 10 amino acids, e.g., 1, 2, 3, 4, 5, 6, 7, 8, 9, or 10, from the mature polypeptide of SEQ ID NO: 74. The polypeptide preferably comprises, consists of, or consists essentially of the amino acid sequence of SEQ ID NO: 74 or the mature polypeptide thereof, or is a fragment thereof having pectinase activity. In one aspect, the mature polypeptide is amino acids 19 to 396 of SEQ ID NO: 74. In another aspect, the mature polypeptide is SEQ ID NO: 75.

In an embodiment, the present invention relates to isolated or purified polypeptides having a sequence identity of at least 60% identity, at least 65% identity, at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 83, which have pectinase activity. In an embodiment, the polypeptides differ by up to 10 amino acids, e.g., 1, 2, 3, 4, 5, 6, 7, 8, 9, or 10, from the mature polypeptide of SEQ ID NO: 83. The polypeptide preferably comprises, consists of, or consists essentially of the mature polypeptide of SEQ ID NO: 83 or the mature polypeptide thereof, or is a fragment thereof having pectinase activity. In one aspect, the mature polypeptide is amino acids 19 to 253 of SEQ ID NO: 83. In another aspect, the mature polypeptide is SEQ ID NO: 84.

In an embodiment, the present invention relates to isolated or purified polypeptides having a sequence identity of at least 98.6% identity, at least 98.7% identity, at least 98.8% identity, at least 98.9% identity, at least 99% identity, at least 99.1% identity, at least 99.2% identity, at least 99.3% identity, at least 99.4% identity, at least 99.5% identity, at least 99.6% identity, at least 99.7% identity, at least 99.8% identity, or at least 99.9% identity to the mature polypeptide of SEQ ID NO: 89, which have pectinase activity. In an embodiment, the polypeptide differs by up to 10 amino acids, e.g., 1, 2, 3, 4, 5, 6, 7, 8, 9, or 10, from the mature polypeptide of SEQ ID NO: 89. The polypeptide preferably comprises, consists of, or consists essentially of the mature polypeptide of SEQ ID NO: 89 or the mature polypeptide thereof, or is a fragment thereof having pectinase activity. In one aspect, the mature polypeptide is amino acids 19 to 340 of SEQ ID NO: 89. In another aspect, the mature polypeptide is SEQ ID NO: 90.

In an embodiment, the present invention relates to isolated or purified polypeptides having a sequence identity of at least 60% identity, at least 65% identity, at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 92, which have pectinase activity. In an embodiment, the polypeptides differ by up to 10 amino acids, e.g., 1, 2, 3, 4, 5, 6, 7, 8, 9, or 10, from the mature polypeptide of SEQ ID NO: 92. The polypeptide preferably comprises, consists of, or consists essentially of the mature polypeptide of SEQ ID NO: 92 or the mature polypeptide thereof, or is a fragment thereof having pectinase activity. In one aspect, the mature polypeptide is amino acids 23 to 256 of SEQ ID NO: 92. In another aspect, the mature polypeptide is SEQ ID NO: 93.

In an embodiment, the present invention relates to isolated or purified polypeptides having a sequence identity of at least 60% identity, at least 65% identity, at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 137, which have pectinase activity. In an embodiment, the polypeptides differ by up to 10 amino acids, e.g., 1, 2, 3, 4, 5, 6, 7, 8, 9, or 10, from the mature polypeptide of SEQ ID NO: 137. The polypeptide preferably comprises, consists of, or consists essentially of the mature polypeptide of SEQ ID NO: 137 or the mature polypeptide thereof, or is a fragment thereof having pectinase activity. In one aspect, the mature polypeptide is amino acids 24 to 592 of SEQ ID NO: 137. In another aspect, the mature polypeptide is SEQ ID NO: 138.

In an embodiment, the present invention relates to isolated or purified polypeptides having a sequence identity of at least 60% identity, at least 65% identity, at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 140, which have pectinase activity. In an embodiment, the polypeptides differ by up to 10 amino acids, e.g., 1, 2, 3, 4, 5, 6, 7, 8, 9, or 10, from the mature polypeptide of SEQ ID NO: 140. The polypeptide preferably comprises, consists of, or consists essentially of the mature polypeptide of SEQ ID NO: 140 or the mature polypeptide thereof, or is a fragment thereof having pectinase activity. In one aspect, the mature polypeptide is amino acids 20 to 546 of SEQ ID NO: 140. In another aspect, the mature polypeptide is SEQ ID NO: 141.

In an embodiment, the present invention relates to isolated or purified polypeptides having a sequence identity of at least 60% identity, at least 65% identity, at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 143, which have pectinase activity. In an embodiment, the polypeptides differ by up to 10 amino acids, e.g., 1, 2, 3, 4, 5, 6, 7, 8, 9, or 10, from the mature polypeptide of SEQ ID NO: 143. The polypeptide preferably comprises, consists of, or consists essentially of the mature polypeptide of SEQ ID NO: 143 or the mature polypeptide thereof, or is a fragment thereof having pectinase activity. In one aspect, the mature polypeptide is amino acids 21 to 380 of SEQ ID NO: 143. In another aspect, the mature polypeptide is SEQ ID NO: 144.

In an embodiment, the present invention relates to isolated or purified polypeptides having a sequence identity of at least 60% identity, at least 65% identity, at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 146, which have pectinase activity. In an embodiment, the polypeptides differ by up to 10 amino acids, e.g., 1, 2, 3, 4, 5, 6, 7, 8, 9, or 10, from the mature polypeptide of SEQ ID NO: 146. The polypeptide preferably comprises, consists of, or consists essentially of the mature polypeptide of SEQ ID NO: 146 or the mature polypeptide thereof, or is a fragment thereof having pectinase activity. In one aspect, the mature polypeptide is amino acids 20 to 470 of SEQ ID NO: 146. In another aspect, the mature polypeptide is SEQ ID NO: 147.

In an embodiment, the present invention relates to isolated or purified polypeptides having a sequence identity of at least 60%, at least 65%, at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99%, but less than 100%, identity to the mature polypeptide of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 95, SEQ ID NO: 98, SEQ ID NO: 101, SEQ ID NO: 104, SEQ ID NO: 137, SEQ ID NO: 140, SEQ ID NO: 143, or SEQ ID NO: 146, which have pectinase activity. In an embodiment, the polypeptides differ by up to 10 amino acids, e.g., 1, 2, 3, 4, 5, 6, 7, 8, 9, or 10, from the mature polypeptide of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 95, SEQ ID NO: 98, SEQ ID NO: 101, or SEQ ID NO: 104. The polypeptide preferably comprises, consists of, or consists essentially of the mature polypeptide of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 95, SEQ ID NO: 98, SEQ ID NO: 101, SEQ ID NO: 104, or SEQ ID NO: 137 or is a fragment thereof having pectinase activity.

In some embodiments, the present invention relates to isolated or purified polypeptides having pectinase activity encoded by polynucleotides that hybridize under medium stringency conditions, medium-high stringency conditions, high stringency conditions, or very high stringency conditions with the full-length complement of the mature polypeptide coding sequence of SEQ ID NO: 1, SEQ ID NO: 4, SEQ ID NO: 7, SEQ ID NO: 10, SEQ ID NO: 13, SEQ ID NO: 16, SEQ ID NO: 19, SEQ ID NO: 22, SEQ ID NO: 25, SEQ ID NO: 28, SEQ ID NO: 31, SEQ ID NO: 34, SEQ ID NO: 37, SEQ ID NO: 40, SEQ ID NO: 43, SEQ ID NO: 46, SEQ ID NO: 49, SEQ ID NO: 52, SEQ ID NO: 55, SEQ ID NO: 58, SEQ ID NO: 61, SEQ ID NO: 64, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 91, SEQ ID NO: 94, SEQ ID NO: 97, SEQ ID NO: 100, or SEQ ID NO: 103, or the cDNA SEQ ID NO: 1, SEQ ID NO: 4, SEQ ID NO: 7, SEQ ID NO: 10, SEQ ID NO: 13, SEQ ID NO: 16, SEQ ID NO: 19, SEQ ID NO: 22, SEQ ID NO: 25, SEQ ID NO: 28, SEQ ID NO: 31, SEQ ID NO: 34, SEQ ID NO: 37, SEQ ID NO: 40, SEQ ID NO: 43, SEQ ID NO: 46, SEQ ID NO: 49, SEQ ID NO: 52, SEQ ID NO: 55, SEQ ID NO: 58, SEQ ID NO: 61, SEQ ID NO: 64, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 91, SEQ ID NO: 94, SEQ ID NO: 97, SEQ ID NO: 100, SEQ ID NO: 103, SEQ ID NO: 136, SEQ ID NO: 139, SEQ ID NO: 142, or SEQ ID NO: 145 (Sambrook et al., 1989, *Molecular Cloning, A Laboratory Manual,* 2d edition, Cold Spring Harbor, New York).

The polynucleotide of SEQ ID NO: 1, SEQ ID NO: 4, SEQ ID NO: 7, SEQ ID NO: 10, SEQ ID NO: 13, SEQ ID NO: 16, SEQ ID NO: 19, SEQ ID NO: 22, SEQ ID NO: 25, SEQ ID NO: 28, SEQ ID NO: 31, SEQ ID NO: 34, SEQ ID NO: 37, SEQ ID NO: 40, SEQ ID NO: 43, SEQ ID NO: 46, SEQ ID NO: 49, SEQ ID NO: 52, SEQ ID NO: 55, SEQ ID NO: 58, SEQ ID NO: 61, SEQ ID NO: 64, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 91, SEQ ID NO: 94, SEQ ID NO: 97, SEQ ID NO: 100, or SEQ ID NO: 103, or a subsequence of any thereof, as well as the mature polypeptide of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 24, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 95, SEQ ID NO: 98, SEQ ID NO: 101, SEQ ID NO: 104, SEQ ID NO: 136, SEQ ID NO: 139, SEQ ID NO: 142, or SEQ ID NO: 145 or a fragment of any thereof, may be used to design nucleic acid probes to identify and clone DNA encoding polypeptides having pectinase activity from strains of different genera or species according to methods well known in the art. Such probes can be used for hybridization with the genomic DNA or cDNA of a cell of interest, following standard Southern blotting procedures, in order to identify and isolate the corresponding gene therein. Such probes can be considerably shorter than the entire sequence, but should be at least 15, e.g., at least 25, at least 35, or at least 70 nucleotides in length. Preferably, the nucleic acid probe is at least 100 nucleotides in length, e.g., at least 200 nucleotides, at least 300 nucleotides, at least 400 nucleotides, at least 500 nucleotides, at least 600 nucleotides, at least 700 nucleotides, at least 800 nucleotides, or at least 900 nucleotides in length. Both DNA and RNA probes can be used. The probes are typically labeled for detecting the corresponding gene (for example, with $^{32}P$, $^{3}H$, $^{31}S$, biotin, or avidin). Such probes are encompassed by the present invention.

A genomic DNA or cDNA library prepared from such other strains may be screened for DNA that hybridizes with the probes described above and encodes a polypeptide having pectinase activity. Genomic or other DNA from such other strains may be separated by agarose or polyacrylamide gel electrophoresis, or other separation techniques. DNA from the libraries or the separated DNA may be transferred to and immobilized on nitrocellulose or another suitable carrier material. In order to identify a clone or DNA that hybridizes with SEQ ID NO: 1, SEQ ID NO: 4, SEQ ID NO: 7, SEQ ID NO: 10, SEQ ID NO: 13, SEQ ID NO: 16, SEQ ID NO: 19, SEQ ID NO: 22, SEQ ID NO: 25, SEQ ID NO: 28, SEQ ID NO: 31, SEQ ID NO: 34, SEQ ID NO: 37, SEQ ID NO: 40, SEQ ID NO: 43, SEQ ID NO: 46, SEQ ID NO: 49, SEQ ID NO: 52, SEQ ID NO: 55, SEQ ID NO: 58, SEQ ID NO: 61, SEQ ID NO: 64, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 91, SEQ ID NO: 94, SEQ ID NO: 97, SEQ ID NO: 100, SEQ ID NO: 103, SEQ ID NO: 136, SEQ ID NO: 139, SEQ ID NO: 142, or SEQ ID NO: 145 or a subsequence of SEQ ID NO: 1, SEQ ID NO: 4, SEQ ID NO: 7, SEQ ID NO: 10, SEQ ID NO: 13, SEQ ID NO: 16, SEQ ID NO: 19, SEQ ID NO: 22, SEQ ID NO: 25, SEQ ID NO: 28, SEQ ID NO: 31, SEQ ID NO: 34, SEQ ID NO: 37, SEQ ID NO: 40, SEQ ID NO: 43, SEQ ID NO: 46, SEQ ID NO: 49, SEQ ID NO: 52, SEQ ID NO: 55, SEQ ID NO: 58, SEQ ID NO: 61, SEQ ID NO: 64, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 91, SEQ ID NO: 94, SEQ ID NO: 97, SEQ ID NO: 100, SEQ ID NO: 103, or SEQ ID NO: 136, SEQ ID NO: 139, SEQ ID NO: 142, or SEQ ID NO: 145, the carrier material is used in a Southern blot.

For purposes of the present invention, hybridization indicates that the polynucleotides hybridize to a labeled nucleic acid probe corresponding to (i) SEQ ID NO: 1, SEQ ID NO: 4, SEQ ID NO: 7, SEQ ID NO: 10, SEQ ID NO: 13, SEQ ID NO: 16, SEQ ID NO: 19, SEQ ID NO: 22, SEQ ID NO: 25, SEQ ID NO: 28, SEQ ID NO: 31, SEQ ID NO: 34, SEQ ID NO: 37, SEQ ID NO: 40, SEQ ID NO: 43, SEQ ID NO: 46, SEQ ID NO: 49, SEQ ID NO: 52, SEQ ID NO: 55, SEQ ID NO: 58, SEQ ID NO: 61, SEQ ID NO: 64, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 91, SEQ ID NO: 94, SEQ ID NO: 97, SEQ ID NO: 100, SEQ ID NO: 103, SEQ ID NO: 136, SEQ ID NO: 139, SEQ ID NO: 142, or SEQ ID NO: 145; (ii) the mature polypeptide coding sequence of SEQ ID NO: 1, SEQ ID NO: 4, SEQ ID NO: 7, SEQ ID NO: 10, SEQ ID NO: 13, SEQ ID NO: 16, SEQ ID NO: 19, SEQ ID NO: 22, SEQ ID NO: 25, SEQ ID NO: 28, SEQ ID NO: 31, SEQ ID NO: 34, SEQ ID NO: 37, SEQ ID NO: 40, SEQ ID NO: 43, SEQ ID NO: 46, SEQ ID NO: 49, SEQ ID NO: 52, SEQ ID NO: 55, SEQ ID NO: 58, SEQ ID NO: 61, SEQ ID NO: 64, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 91, SEQ ID NO: 94, SEQ ID NO: 97, SEQ ID NO: 100, SEQ ID NO: 103, SEQ ID NO: 136, SEQ ID NO: 139, SEQ ID NO: 142, or SEQ ID NO: 145; (iii) the cDNA sequences of SEQ ID NO: 1, SEQ ID NO: 4, SEQ ID NO: 7, SEQ ID NO: 10, SEQ ID NO: 13, SEQ ID NO: 16, SEQ ID NO: 19, SEQ ID NO: 22, SEQ ID NO: 25, SEQ ID NO: 28, SEQ ID NO: 31, SEQ ID NO: 34, SEQ ID NO: 37, SEQ ID NO: 40, SEQ ID NO: 43, SEQ ID NO: 46, SEQ ID NO: 49, SEQ ID NO: 52, SEQ ID NO: 55, SEQ ID NO: 58, SEQ ID NO: 61, SEQ ID NO: 64, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 91, SEQ ID NO: 94, SEQ ID NO: 97, SEQ ID NO: 100, SEQ ID NO: 103, SEQ ID NO: 136, SEQ ID NO: 139, SEQ ID NO: 142, or SEQ ID NO: 145; (iv) the full-length complement of SEQ ID NO: 1, SEQ ID NO: 4, SEQ ID NO: 7, SEQ ID NO: 10, SEQ ID NO: 13, SEQ ID NO: 16, SEQ ID NO: 19, SEQ ID NO: 22, SEQ ID NO: 25, SEQ ID NO: 28, SEQ ID NO: 31, SEQ ID NO: 34, SEQ ID NO: 37, SEQ ID NO: 40, SEQ ID NO: 43, SEQ ID NO: 46, SEQ ID NO: 49, SEQ ID NO: 52, SEQ ID NO: 55, SEQ ID NO: 58, SEQ ID NO: 61, SEQ ID NO: 64, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 91, SEQ ID NO: 94, SEQ ID NO: 97, SEQ ID NO: 100, SEQ ID NO: 103, SEQ ID NO: 136, SEQ ID NO: 139, SEQ ID NO: 142, or SEQ ID NO: 145; or (v) a subsequence of SEQ ID NO: 1, SEQ ID NO: 4, SEQ ID NO: 7, SEQ ID NO: 10, SEQ ID NO: 13, SEQ ID NO: 16, SEQ ID NO: 19, SEQ ID NO: 22, SEQ ID NO: 25, SEQ ID NO: 28, SEQ ID NO: 31, SEQ ID NO: 34, SEQ ID NO: 37, SEQ ID NO: 40, SEQ ID NO: 43, SEQ ID NO: 46, SEQ ID NO: 49, SEQ ID NO: 52, SEQ ID NO: 55, SEQ ID NO: 58, SEQ ID NO: 61, SEQ ID NO: 64, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 91, SEQ ID NO: 94, SEQ ID NO: 97, SEQ ID NO: 100, SEQ ID NO: 103, SEQ ID NO: 136, SEQ ID NO: 139, SEQ ID NO: 142, or SEQ ID NO: 145; under medium to very high stringency conditions. Molecules to which the nucleic acid probe hybridizes under these conditions can be detected using, for example, X-ray film or any other detection means known in the art.

In another aspect, the nucleic acid probe is a polynucleotide that encodes the mature polypeptide of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 24, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 95, SEQ ID NO: 98, SEQ ID NO: 101, SEQ ID NO: 104, SEQ ID NO: 137, SEQ ID NO: 140, SEQ ID NO: 143, or SEQ ID NO: 146; or a fragment of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 24, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 95, SEQ ID NO: 98, SEQ ID NO: 101, SEQ ID NO: 104, SEQ ID NO: 137, SEQ ID NO: 140, SEQ ID NO: 143, or SEQ ID NO: 146. In another aspect, the nucleic acid probe is SEQ ID NO: 1, SEQ ID NO: 4, SEQ ID NO: 7, SEQ ID NO: 10, SEQ ID NO: 13, SEQ ID NO: 16, SEQ ID NO: 19, SEQ ID NO: 22, SEQ ID NO: 25, SEQ ID NO: 28, SEQ ID NO: 31, SEQ ID NO: 34, SEQ ID NO: 37, SEQ ID NO: 40, SEQ ID NO: 43, SEQ ID NO: 46, SEQ ID NO: 49, SEQ ID NO: 52, SEQ ID NO: 55, SEQ ID NO: 58, SEQ ID NO: 61, SEQ ID NO: 64, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 91, SEQ ID NO: 94, SEQ ID NO: 97, SEQ ID NO: 100, SEQ ID NO: 103, SEQ ID NO: 136, SEQ ID NO: 139, SEQ ID NO: 142, or SEQ ID NO: 145, or the cDNA sequences of SEQ ID NO: 1, SEQ ID NO: 4, SEQ ID NO: 7, SEQ ID NO: 10, SEQ ID NO: 13, SEQ ID NO: 16, SEQ ID NO: 19, SEQ ID NO: 22, SEQ ID NO: 25, SEQ ID NO: 28, SEQ ID NO: 31, SEQ ID NO: 34, SEQ ID NO: 37, SEQ ID NO: 40, SEQ ID NO: 43, SEQ ID NO: 46, SEQ ID NO: 49, SEQ ID NO: 52, SEQ ID NO: 55, SEQ ID NO: 58, SEQ ID NO: 61, SEQ ID NO: 64, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 91, SEQ ID NO: 94, SEQ ID NO: 97, SEQ ID NO: 100, SEQ ID NO: 103, SEQ ID NO: 136, SEQ ID NO: 139, SEQ ID NO: 142, or SEQ ID NO: 145.

In some embodiments, the present invention relates to isolated polypeptides having pectinase activity encoded by polynucleotides having a sequence identity of at least 60%, e.g., at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% to: (i) the mature polypeptide coding sequence of SEQ ID NO: 1, SEQ ID NO: 4, SEQ ID NO: 7, SEQ ID NO: 10, SEQ ID NO: 13, SEQ ID NO: 16, SEQ ID NO: 19, SEQ ID NO: 22, SEQ ID NO: 25, SEQ ID NO: 28, SEQ ID NO: 31, SEQ ID NO: 34, SEQ ID NO: 37, SEQ ID NO: 40, SEQ ID NO: 43, SEQ ID NO: 46, SEQ ID NO: 49, SEQ ID NO: 52, SEQ ID NO: 55, SEQ ID NO: 58, SEQ ID NO: 61, SEQ ID NO: 64, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 91, SEQ ID NO: 94, SEQ ID NO: 97, SEQ ID NO: 100, SEQ ID NO: 103, SEQ ID NO: 136, SEQ ID NO: 139, SEQ ID NO: 142, or SEQ ID NO: 145 or (ii) the cDNA sequences of SEQ ID NO: 1, SEQ ID NO: 4, SEQ ID NO: 7, SEQ ID NO: 10, SEQ ID NO: 13, SEQ ID NO: 16, SEQ ID NO: 19, SEQ ID NO: 22, SEQ ID NO: 25, SEQ ID NO: 28, SEQ ID NO: 31, SEQ ID NO: 34, SEQ ID NO: 37, SEQ ID NO: 40, SEQ ID NO: 43, SEQ ID NO: 46, SEQ ID NO: 49, SEQ ID NO: 52, SEQ ID NO: 55, SEQ ID NO: 58, SEQ ID NO: 61, SEQ ID NO: 64, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 91, SEQ ID NO: 94, SEQ ID NO: 97, SEQ ID NO: 100, SEQ ID NO: 103, SEQ ID NO: 136, SEQ ID NO: 139, SEQ ID NO: 142, or SEQ ID NO: 145.

The polynucleotide encoding the polypeptide preferably comprises, consists essentially of, or consists of: nucleotides 1 to 1110 of SEQ ID NO: 1; nucleotides 1 to 231 and 282 to 1160 of SEQ ID NO: 4, or the cDNA sequence thereof; nucleotides 1 to 261, 355 to 777, 847 to 976, and 1148 to 1470 of SEQ ID NO: 7, or the cDNA sequence thereof; nucleotides 1 to 216, 269 to 685 and 744 to 1202 of SEQ ID NO: 10, or the cDNA sequence thereof; nucleotides 1 to 307, 402 to 771, 830 to 888, 957 to 1117, 1186 to 1374, 1449 to 1550, 1616 to 1690 and 1751 to 1798 of SEQ ID NO: 13, or the cDNA sequence thereof; nucleotides 1 to 267, 326 to 748, 826 to 955 and 1014 to 1336 of SEQ ID NO: 16, or the cDNA sequence thereof; nucleotides 1 to 351, 416 to 583, 637 to 810, 856 to 1101 and 1151 to 1552 of SEQ ID NO: 19, or the cDNA sequence thereof; nucleotides 1 to 1155 of SEQ ID NO: 22; nucleotides 1 to 234, 287 to 706 and 768 to 1226 of SEQ ID NO: 25, or the cDNA sequence thereof; nucleotides 1 to 300, 352 to 660, 714 to 859, 918 to 1371 and 1449 to 1730 of SEQ ID NO: 28, or the cDNA sequence thereof; nucleotides 1 to 1476 of SEQ ID NO: 31; nucleotides 1 to 228 and 276 to 1160 of SEQ ID NO: 34, or the cDNA sequence thereof; nucleotides 1 to 231, 327 to 746 and 847 to 1305 of SEQ ID NO: 37, or the cDNA sequence thereof; nucleotides 1 to 630 and 700 to 1158 of SEQ ID NO: 40, or the cDNA sequence thereof; nucleotides 1 to 228, 280 to 699 and 750 to 1208 of SEQ ID NO: 43, or the cDNA sequence thereof; nucleotides 1 to 282, 350 to 716, 776 to 975 and 1064 to 1504 of SEQ ID NO: 46, or the cDNA sequence thereof; nucleotides 1 to 624, 689 to 727, 792 to 993 and 1060 to 1517 of SEQ ID NO: 49, or the cDNA sequence thereof; nucleotides 1 to 1428 of SEQ ID NO: 52; nucleotides 1 to 1410 of SEQ ID NO: 55; nucleotides 1 to 1134 and 1186 to 1416 of SEQ ID NO: 58, or the cDNA sequence thereof; nucleotides 1 to 264, 319 to 685, 746 to 945 and 997 to 1437 of SEQ ID NO: 61, or the cDNA sequence thereof; nucleotides 1 to 993 of SEQ ID NO: 64; nucleotides 1 to 645 and 696 to 1250 of SEQ ID NO: 67, or the cDNA sequence thereof; nucleotides 1 to 633 and 690 to 1247 of SEQ ID NO: 70, or the cDNA sequence thereof; nucleotides 1 to 633 and 689 to 1246 of SEQ ID NO: 73, or the cDNA sequence thereof; nucleotides 1 to 723 and 780 to 1193 of SEQ ID NO: 76, or the cDNA sequence thereof; nucleotides 1 to 203, 266 to 409, 467 to 592, 649 to 979 and 1036 to 1371 of SEQ ID NO: 79, or the cDNA sequence thereof; nucleotides 1 to 288, 370 to 474 and 572 to 940 of SEQ ID NO: 82, or the cDNA sequence thereof; nucleotides 1 to 753 of SEQ ID NO: 85; nucleotides 1 to 1020 of SEQ ID NO: 88; nucleotides 1 to 417 and 472 to 825 of SEQ ID NO: 91, or the cDNA sequence thereof; nucleotides 1 to 256, 312 to 413, 474 to 595, 651 to 720, 769 to 844, 892 to 943, 995 to 1206, 1257 to 1478, 1551 to 1797, 1870 to 2010, 2073 to 2129 and 2204 to 2233 of SEQ ID NO: 94, or the cDNA sequence thereof; nucleotides 1 to 1992 of SEQ ID NO: 97; nucleotides 1 to 1584 of SEQ ID NO: 100; nucleotides 1 to 324 and 395 to 1123 of SEQ ID NO: 103, or the cDNA sequence thereof; nucleotides 1 to 226, 295 to 911, and 975 to 1880 of SEQ ID NO: 136, or the cDNA sequence thereof; nucleotides 61 to 618, 669 to 856, 914 to 1559 and 1608 to 1796 of SEQ ID NO: 139, or the cDNA sequence thereof; nucleotides 61 to 261, 328 to 750, 806 to 935, and 1010 to 1338 of SEQ ID NO: 142, or the cDNA sequence thereof; or nucleotides 58 to 1413 of SEQ ID NO: 145, or the cDNA sequence thereof.

In some embodiments, the present invention relates to a polypeptide derived from a mature polypeptide of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 95, SEQ ID NO: 98, SEQ ID NO: 101, SEQ ID NO: 104, SEQ ID NO: 137, SEQ ID NO: 140, SEQ ID NO: 143, or SEQ ID NO: 146 by substitution, deletion or addition of one or several amino acids in the mature polypeptide of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 95, SEQ ID NO: 98, SEQ ID NO: 101, SEQ ID NO: 104, SEQ ID NO: 137, SEQ ID NO: 140, SEQ ID NO: 143, or SEQ ID NO: 146. In some embodiments, the present invention relates to variants of the mature polypeptide of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 95, SEQ ID NO: 98, SEQ ID NO: 101, SEQ ID NO: 104, SEQ ID NO: 137, SEQ ID NO: 140, SEQ ID NO: 143, or SEQ ID NO: 146 comprising a substitution, deletion, and/or insertion at one or more (e.g., several) positions. In one aspect, the number of amino acid substitutions, deletions and/or insertions introduced into the mature polypeptide of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 95, SEQ ID NO: 98, SEQ ID NO: 101, SEQ ID NO: 104, SEQ ID NO: 137, SEQ ID NO: 140, SEQ ID NO: 143, or SEQ ID NO: 146 is up to 10, e.g., 1, 2, 3, 4, 5, 6, 7, 8, 9, or 10. In an embodiment, the polypeptide has an N-terminal extension and/or C-terminal extension of 1-10 amino acids, e.g., 1, 2, 3, 4, 5, 6, 7, 8, 9, or 10 amino acids. The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a poly-histidine tract, an antigenic epitope or a binding module.

In another embodiment, the present invention relates to a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity, but less than 100% identity to the mature polypeptide of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, SEQ ID NO: 44 or SEQ ID NO: 143, and wherein the polypeptide has at least 75%, at least 80%, at least 85%, at least 90%, at least 95%, at least 96%, at least 97%, at least 98%, or at least 99% of the pectinase activity (e.g., polygalacturonase activity) of the mature polypeptide of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, SEQ ID NO: 44 or SEQ ID NO: 143.

In another embodiment, the present invention relates to a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity, but less than 100% identity, to the mature polypeptide of any one or more of SEQ ID NO: 47, SEQ ID NO: 50, SEQ ID NO: 53, SEQ ID NO: 56, SEQ ID NO: 59, SEQ ID NO: 62, SEQ ID NO: 134, or SEQ ID NO: 146, and wherein the polypeptide has at least 75%, at least 80%, at least 85%, at least 90%, at least 95%, at least 96%, at least 97%, at least 98%, or at least 99% of the pectinase activity (e.g., rhamnogalacturonase activity) of the mature polypeptide of SEQ ID NO: 47, SEQ ID NO: 50, SEQ ID NO: 53, SEQ ID NO: 56, SEQ ID NO: 59, SEQ ID NO: 62, SEQ ID NO: 134 or SEQ ID NO: 146.

In another embodiment, the present invention relates to a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity, but less than 100% identity, to the mature polypeptide of SEQ ID NO: 65, SEQ ID NO: 68, SEQ ID NO: 71 or SEQ ID NO: 74, and wherein the polypeptide has at least 75%, at least 80%, at least 85%, at least 90%, at least 95%, at least 96%, at least 97%, at least 98%, or at least 99% of the pectinase activity (e.g., pectin methyl esterase activity) of the mature polypeptide of SEQ ID NO: 65, SEQ ID NO: 68, SEQ ID NO: 71 or SEQ ID NO: 74.

In another embodiment, the present invention relates to a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity, but less than 100% identity, to the mature polypeptide of SEQ ID NO: 77, SEQ ID NO: 80, or SEQ ID NO: 106, and wherein the polypeptide has at least 75%, at least 80%, at least 85%, at least 90%, at least 95%, at least 96%, at least 97%, at least 98%, or at least 99% of the pectinase activity (e.g., pectin lyase activity) of the mature polypeptide of SEQ ID NO: 77, SEQ ID NO: 80, or SEQ ID NO: 106.

In another embodiment, the present invention relates to a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity, but less than 100% identity, to the mature polypeptide of SEQ ID NO: 83, SEQ ID NO: 86, SEQ ID NO: 89 or SEQ ID NO: 92, and wherein the polypeptide has at least 75%, at least 80%, at least 85%, at least 90%, at least 95%, at least 96%, at least 97%, at least 98%, or at least 99% of the pectinase activity (e.g., pectin acetyl esterase activity) of the mature polypeptide of SEQ ID NO: 83, SEQ ID NO: 86, SEQ ID NO: 89 or SEQ ID NO: 92.

In another embodiment, the present invention relates to a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity, but less than 100% identity, to the mature polypeptide of SEQ ID NO: 95, SEQ ID NO: 98, SEQ ID NO: 101, SEQ ID NO: 137, or SEQ ID NO: 140, and wherein the polypeptide has at least 75%, at least 80%, at least 85%, at least 90%, at least 95%, at least 96%, at least 97%, at least 98%, or at least 99% of the pectinase activity (e.g., rhamnogalacturonan lyase activity) of the mature polypeptide of SEQ ID NO: 95, SEQ ID NO: 98, SEQ ID NO: 101, SEQ ID NO: 137, or SEQ ID NO: 140.

In another embodiment, the present invention relates to a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity, but less than 100% identity, to the mature polypeptide of SEQ ID NO: 104, and wherein the polypeptide has at least 75%, at least 80%, at least 85%, at least 90%, at least 95%, at least 96%, at least 97%, at least 98%, or at least 99% of the pectinase activity (e.g., beta-galactanase activity) of the mature polypeptide of SEQ ID NO: 104.

Essential amino acids in a polypeptide can be identified by procedures known in the art, such as site-directed mutagenesis or alanine-scanning mutagenesis (Cunningham and Wells, 1989, *Science* 244: 1081-1085). In the latter technique, single alanine mutations are introduced at every residue in the molecule, and the resultant molecules are tested for pectinase activity (e.g., polygalacturonase activity, rhamnogalacturonase activity, pectin methyl esterase, pectin lyase, pectin acetyl esterase, rhamnogalacturonan lyase, beta-galactanase, etc.) to identify amino acid residues that are critical to the activity of the molecule. See also, Hilton et al., 1996, *J. Biol. Chem.* 271: 4699-4708. The active site of the enzyme or other biological interaction can also be determined by physical analysis of structure, as determined by such techniques as nuclear magnetic resonance, crystallography, electron diffraction, or photoaffinity labeling, in conjunction with mutation of putative contact site amino acids. See, for example, de Vos et al., 1992, *Science* 255: 306-312; Smith et al., 1992, *J. Mol. Biol.* 224: 899-904; Wlodaver et al., 1992, *FEBS Lett.* 309: 59-64. The identity of essential amino acids can also be inferred from an alignment with a related polypeptide.

Single or multiple amino acid substitutions, deletions, and/or insertions can be made and tested using known methods of mutagenesis, recombination, and/or shuffling, followed by a relevant screening procedure, such as those disclosed by Reidhaar-Olson and Sauer, 1988, *Science* 241: 53-57; Bowie and Sauer, 1989, *Proc. Natl. Acad. Sci. USA* 86: 2152-2156; WO 95/17413; or WO 95/22625. Other methods that can be used include error-prone PCR, phage display (e.g., Lowman et al., 1991, *Biochemistry* 30: 10832-10837; U.S. Pat. No. 5,223,409; WO 92/06204), and region-directed mutagenesis (Derbyshire et al., 1986, *Gene* 46: 145; Ner et al., 1988, *DNA* 7:127).

Mutagenesis/shuffling methods can be combined with high-throughput, automated screening methods to detect activity of cloned, mutagenized polypeptides expressed by host cells (Ness et al., 1999, *Nature Biotechnology* 17: 893-896). Mutagenized DNA molecules that encode active polypeptides can be recovered from the host cells and rapidly sequenced using standard methods in the art. These methods allow the rapid determination of the importance of individual amino acid residues in a polypeptide.

The polypeptide may be a hybrid polypeptide or a fusion polypeptide.

Sources of Polypeptides Having Pectinase Activity

A polypeptide having pectinase activity (e.g., polygalacturonase activity, rhamnogalacturonase activity, pectin methyl esterase, pectin lyase, pectin acetyl esterase, rhamnogalacturonan lyase, beta-galactanase, etc.) of the present invention may be obtained from microorganisms of any genus. For purposes of the present invention, the term "obtained from" as used herein in connection with a given source shall mean that the polypeptide encoded by a polynucleotide is produced by the source or by a strain in which the polynucleotide from the source has been inserted. In one aspect, the polypeptide obtained from a given source is secreted extracellularly. In an embodiment, the polypeptide having pectinase activity is of fungal origin. In an embodiment, the polypeptide having pectinase activity is of fungal origin. In an embodiment, the polypeptide having polygalacturonase activity is of fungal origin. In an embodiment, the polypeptide having rhamnogalacturonase activity is of fungal origin. In an embodiment, the polypeptide having pectin methyl esterase activity is of fungal origin. In an embodiment, the polypeptide having pectin lyase activity is of fungal origin. In an embodiment, the polypeptide having pectin acetyl esterase activity is of fungal origin. In an embodiment, the polypeptide having rhamnogalacturonan lyase activity is of fungal origin. In an embodiment, the polypeptide having beta-galactanase activity is of fungal origin.

In another aspect, the polypeptide having pectinase activity e.g., polygalacturonase activity, rhamnogalacturonase activity, pectin methyl esterase, pectin lyase, pectin acetyl esterase, rhamnogalacturonan lyase, beta-galactanase, etc.) of the present invention may be obtained from microorganisms of the genus *Aspergillus*, e.g., a polypeptide obtained from *Aspergillus niger, Aspergillus aculeatus, Aspergillus luchuensis, Aspergillus oryzae*, or from microorganisms of the genus *Thermoascus*, e.g., a polypeptide obtained from *Thermoascus crustaceus*, or from microorganisms of the genus *Talaromyces*, e.g., a polypeptided obtained from *Talaromyces leycettanus, Talaromyces calidicanius, Talaromyces* sp. XZ2925 or from microorganisms of the genus *Thielavia*, e.g., a polypeptide obtained from *Thielavia hyrcaniae*, or from microorganisms of the genus *Penicillium*, e.g., a polypeptide obtained from *Penicillium oxalicum, Penicillium* sp. XY2495 or *Penicillium* sp. 54788, from microorganisms of the genus *Colletotrichum*, e.g., a polypeptide obtained from *Colletotrichum gloeosporioides*, or from microorganisms of the genus *Sporormia*, e.g., a polypeptide obtained from *Sporormia fimetaria.*

In an aspect, the polypeptide having pectinase activity is an *Aspergillus niger* polypeptide, for instance, the *Aspergillus niger* polypeptide having pectinase activity (e.g., polygalacturonase activity) of SEQ ID NO: 3 or a polypeptide having pectinase activity (e.g., polygalacturonase activity) that has at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to SEQ ID NO: 3.

In an aspect, the polypeptide having pectinase activity is an *Aspergillus aculeatus* polypeptide, for instance, the *Aspergillus aculeatus* polypeptide having pectinase activity (e.g., polygalacturonase activity) of SEQ ID NO: 6, SEQ ID NO: 9, SEQ ID NO: 12, SEQ ID NO: 15, SEQ ID NO: 18, SEQ ID NO: 21, SEQ ID NO: 24, SEQ ID NO: 33, SEQ ID NO: 38, SEQ ID NO: 41, SEQ ID NO: 44, or a polypeptide having pectinase activity (e.g., polygalacturonase activity) that has at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to SEQ ID NO: 6, SEQ ID NO: 9, SEQ ID NO: 12, SEQ ID NO: 15, SEQ ID NO: 18, SEQ ID NO: 21, SEQ ID NO: 24, SEQ ID NO: 33, SEQ ID NO: 38, SEQ ID NO: 41, or SEQ ID NO: 44.

In an aspect, the polypeptide having pectinase activity is an *Aspergillus luchuensis* polypeptide, for instance, the *Aspergillus luchuensis* polypeptide having pectinase activity (e.g., polygalacturonase activity) of SEQ ID NO: 30 or SEQ ID NO: 36 or a polypeptide having pectinase activity (e.g., polygalacturonase activity) that has at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to SEQ ID NO: 30 or SEQ ID NO: 36.

In an aspect, the polypeptide having pectinase activity is an *Thermoascus crustaceus* polypeptide, for instance, the *Thermoascus crustaceus* polypeptide having pectinase activity (e.g., polygalacturonase activity) of SEQ ID NO: 27 or a polypeptide having pectinase activity (e.g., polygalacturonase activity) that has at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to SEQ ID NO: 27.

In an aspect, the polypeptide having pectinase activity is an *Penicillium oxalicum* polypeptide, for instance, the *Penicillium oxalicum* polypeptide having pectinase activity (e.g., polygalacturonase activity) of SEQ ID NO: 144 or a polypeptide having pectinase activity (e.g., polygalacturonase activity) that has at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to SEQ ID NO: 144.

In an aspect, the polypeptide having pectinase activity is a *Talaromyces leycettanus* polypeptide, for instance, the *Talaromyces leycettanus* polypeptide having pectinase activity (e.g., rhamnogalacturonase activity) of SEQ ID NO: 48 or a polypeptide having pectinase activity (e.g., rhamnogalacturonase activity) that has at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to SEQ ID NO: 48.

In an aspect, the polypeptide having pectinase activity is a *Talaromyces calidicanius* polypeptide, for instance, the *Talaromyces calidicanius* polypeptide having pectinase activity (e.g., rhamnogalacturonase activity) of SEQ ID NO: 48 or a polypeptide having pectinase activity (e.g., rhamnogalacturonase activity) that has at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to SEQ ID NO: 48.

In an aspect, the polypeptide having pectinase activity is a *Talaromyces* sp. XZ2925 polypeptide, for instance, the *Talaromyces* sp. XZ2925 polypeptide having pectinase activity (e.g., rhamnogalacturonase activity) of SEQ ID NO: 147 or a polypeptide having pectinase activity (e.g., rhamnogalacturonase activity) that has at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to SEQ ID NO: 147.

In an aspect, the polypeptide having pectinase activity is an *Aspergillus aculeatus* polypeptide, for instance, the *Aspergillus aculeatus* polypeptide having pectinase activity (e.g., rhamnogalacturonase activity) of SEQ ID NO: 51, or a polypeptide having pectinase activity (e.g., rhamnogalacturonase activity) that has at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to SEQ ID NO: 51.

In an aspect, the polypeptide having pectinase activity is an *Penicillium* sp. XZ2495 polypeptide, for instance, the *Penicillium* sp. XZ2495 polypeptide having pectinase activity (e.g., rhamnogalacturonase activity) of SEQ ID NO: 57, or a polypeptide having pectinase activity (e.g., rhamnogalacturonase activity) that has at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to SEQ ID NO: 57.

In an aspect, the polypeptide having pectinase activity is an *Penicillium* sp. XZ2495 polypeptide, for instance, the *Penicillium* sp. XZ2495 polypeptide having pectinase activity (e.g., rhamnogalacturonase activity) of SEQ ID NO: 60, or a polypeptide having pectinase activity (e.g., rhamnogalacturonase activity) that has at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to SEQ ID NO: 60.

In an aspect, the polypeptide having pectinase activity is an *Aspergillus luchuensis* polypeptide, for instance, the *Aspergillus luchuensis* polypeptide having pectinase activity (e.g., rhamnogalacturonase activity) of SEQ ID NO: 63, or a polypeptide having pectinase activity (e.g., rhamnogalacturonase activity) that has at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to SEQ ID NO: 63.

In an aspect, the polypeptide having pectinase activity is an *Aspergillus oryzae* polypeptide, for instance, the *Aspergillus oryzae* polypeptide having pectinase activity (e.g., rhamnogalacturonase activity) of SEQ ID NO: 134, or a polypeptide having pectinase activity (e.g., rhamnogalacturonase activity) that has at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to SEQ ID NO: 134.

In an aspect, the polypeptide having pectinase activity is an *Aspergillus niger* polypeptide, for instance, the *Aspergillus niger* polypeptide having pectinase activity (e.g., pectin methyl esterase activity) of SEQ ID NO: 66 or a polypeptide having pectinase activity (e.g., pectin methyl esterase activity) that has at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to SEQ ID NO: 66.

In an aspect, the polypeptide having pectinase activity is an *Aspergillus luchuensis* polypeptide, for instance, the *Aspergillus luchuensis* polypeptide having pectinase activity (e.g., pectin methyl esterase activity) of SEQ ID NO: 69, or a polypeptide having pectinase activity (e.g., pectin methyl esterase activity) that has at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to SEQ ID NO: 69.

In an aspect, the polypeptide having pectinase activity is an *Aspergillus aculeatus* polypeptide, for instance, the *Aspergillus aculeatus* polypeptide having pectinase activity (e.g., pectin methyl esterase activity) of SEQ ID NO: 72 or SEQ ID NO: 75, or a polypeptide having pectinase activity (e.g., pectin methyl esterase activity) that has at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to SEQ ID NO: 72 or SEQ ID NO: 75.

In an aspect, the polypeptide having pectinase activity is a *Thielavia hyrcaniae* polypeptide, for instance, the *Thielavia hyrcaniae* polypeptide having pectinase activity (e.g., pectin lyase activity) of SEQ ID NO: 78, or a polypeptide having pectinase activity (e.g., pectin lyase activity) that has at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to SEQ ID NO: 78.

In an aspect, the polypeptide having pectinase activity is an *Aspergillus luchuensis* polypeptide, for instance, the *Aspergillus luchuensis* polypeptide having pectinase activity (e.g., pectin lyase activity) of SEQ ID NO: 81, or a polypeptide having pectinase activity (e.g., pectin lyase activity) that has at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to SEQ ID NO: 81.

In an aspect, the polypeptide having pectinase activity is an *Aspergillus niger* polypeptide, for instance, the *Aspergillus niger* polypeptide having pectinase activity (e.g., pectin lyase activity) of SEQ ID NO: 107, or a polypeptide having pectinase activity (e.g., pectin lyase activity) that has at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to SEQ ID NO: 107.

In an aspect, the polypeptide having pectinase activity is an *Aspergillus aculeatus* polypeptide, for instance, the *Aspergillus aculeatus* polypeptide having pectinase activity (e.g., pectin acetyl esterase activity) of SEQ ID NO: 84, SEQ ID NO: 87, or SEQ ID NO: 90, or a polypeptide having pectinase activity (e.g., pectin acetyl esterase activity) that has at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to SEQ ID NO: 84, SEQ ID NO: 87, or SEQ ID NO: 90.

In an aspect, the polypeptide having pectinase activity is a *Colletotrichum gloeosporioides* polypeptide, for instance, the *Colletotrichum gloeosporioides* polypeptide having pectinase activity (e.g., pectin acetyl esterase activity) of SEQ ID NO: 93, or a polypeptide having pectinase activity (e.g., pectin acetyl esterase activity) that has at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to SEQ ID NO: 93.

In an aspect, the polypeptide having pectinase activity is an *Aspergillus oryzae* polypeptide, for instance, the *Aspergillus oryzae* polypeptide having pectinase activity (e.g., rhamnogalacturonan lyase activity) of SEQ ID NO: 96 or SEQ ID NO: 99, or a polypeptide having pectinase activity (e.g., rhamnogalacturonan lyase activity) that has at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to SEQ ID NO: 96 or SEQ ID NO: 99.

In an aspect, the polypeptide having pectinase activity is an *Aspergillus aculeatus* polypeptide, for instance, the *Aspergillus aculeatus* polypeptide having pectinase activity (e.g., rhamnogalacturonan lyase activity) of SEQ ID NO: 102, or a polypeptide having pectinase activity (e.g., rhamnogalacturonan lyase activity) that has at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to SEQ ID NO: 102.

In an aspect, the polypeptide having pectinase activity is an *Aspergillus aculeatus* polypeptide, for instance, the *Aspergillus aculeatus* polypeptide having pectinase activity (e.g., rhamnogalacturonan lyase activity) of SEQ ID NO: 137, or a polypeptide having pectinase activity (e.g., rhamnogalacturonan lyase activity) that has at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to SEQ ID NO: 137.

In an aspect, the polypeptide having pectinase activity is a *Sporormia fimetaria* polypeptide, for instance, the *Sporormia fimetaria* polypeptide having pectinase activity (e.g., rhamnogalacturonan lyase activity) of SEQ ID NO: 141, or a polypeptide having pectinase activity (e.g., rhamnogalacturonan lyase activity) that has at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to SEQ ID NO: 141.

In an aspect, the polypeptide having pectinase activity is an *Aspergillus aculeatus* polypeptide, for instance, the *Aspergillus aculeatus* polypeptide having pectinase activity (e.g., beta-galactanase activity) of SEQ ID NO: 105, or a polypeptide having pectinase activity (e.g., beta-galactanase activity) that has at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to SEQ ID NO: 105.

It will be understood that for the aforementioned species, the invention encompasses both the perfect and imperfect states, and other taxonomic equivalents, e.g., anamorphs, regardless of the species name by which they are known. Those skilled in the art will readily recognize the identity of appropriate equivalents.

Strains of these species are readily accessible to the public in a number of culture collections, such as the American Type Culture Collection (ATCC), Deutsche Sammlung von Mikroorganismen und Zellkulturen GmbH (DSMZ), Centraalbureau Voor Schimmelcultures (CBS), and Agricultural Research Service Patent Culture Collection, Northern Regional Research Center (NRRL).

The polypeptides may be identified and obtained from other sources including microorganisms isolated from nature (e.g., soil, composts, water, etc.) or DNA samples obtained directly from natural materials (e.g., soil, composts, water, etc.) using the above-mentioned probes. Techniques for isolating microorganisms and DNA directly from natural habitats are well known in the art. A polynucleotide encoding the polypeptide may then be obtained by similarly screening a genomic DNA or cDNA library of another microorganism or mixed DNA sample. Once a polynucleotide encoding a polypeptide has been detected with the probe(s), the polynucleotide can be isolated or cloned by utilizing techniques that are known to those of ordinary skill in the art (see, e.g., Sambrook et al., 1989, supra).

Polynucleotides

The present invention also relates to isolated polynucleotides encoding a polypeptide, a catalytic domain, or carbohydrate binding module of the present invention, as described herein.

The techniques used to isolate or clone a polynucleotide are known in the art and include isolation from genomic DNA or cDNA, or a combination thereof. The cloning of the polynucleotides from genomic DNA can be effected, e.g., by using the polymerase chain reaction (PCR) or antibody screening of expression libraries to detect cloned DNA fragments with shared structural features. See, e.g., Innis et al., 1990, *PCR: A Guide to Methods and Application*, Academic Press, New York. Other nucleic acid amplification procedures such as ligase chain reaction (LCR), ligation activated transcription (LAT) and polynucleotide-based amplification (NASBA) may be used. The polynucleotides may be cloned from a strain of *Aspergillus, Thermoascus, Talaromyces, Penicillium, Thielavia*, and/or *Colletotrichum*, or a related organism and thus, for example, may be a species variant of the polypeptide encoding region of the polynucleotide.

Modification of a polynucleotide encoding a polypeptide of the present invention may be necessary for synthesizing polypeptides substantially similar to the polypeptide. The term "substantially similar" to the polypeptide refers to non-naturally occurring forms of the polypeptide. These polypeptides may differ in some engineered way from the polypeptide isolated from its native source, e.g., variants that differ in specific activity, thermostability, pH optimum, or the like. The variants may be constructed on the basis of the polynucleotide presented as the mature polypeptide coding sequence of SEQ ID NO: 1, SEQ ID NO: 4, SEQ ID NO: 7, SEQ ID NO: 10, SEQ ID NO: 13, SEQ ID NO: 16, SEQ ID NO: 19, SEQ ID NO: 22, SEQ ID NO: 25, SEQ ID NO: 28, SEQ ID NO: 31, SEQ ID NO: 34, SEQ ID NO: 37, SEQ ID NO: 40, SEQ ID NO: 43, SEQ ID NO: 46, SEQ ID NO: 49, SEQ ID NO: 52, SEQ ID NO: 55, SEQ ID NO: 58, SEQ ID NO: 61, SEQ ID NO: 64, SEQ ID NO: 67, SEQ ID NO: 70, or SEQ ID NO: 73, SEQ ID NO: 76, SEQ ID NO: 79, SEQ ID NO: 82, SEQ ID NO: 85, SEQ ID NO: 88, SEQ ID NO: 91, SEQ ID NO: 94, SEQ ID NO: 97, SEQ ID NO: 100, SEQ ID NO: 103, SEQ ID NO: 106, SEQ ID NO: 133, SEQ ID NO: 136, SEQ ID NO: 139, SEQ ID NO: 142, or SEQ ID NO: 145, e.g., a subsequence thereof, and/or by introduction of nucleotide substitutions that do not result in a change in the amino acid sequence of the polypeptide, but which correspond to the codon usage of the host organism intended for production of the enzyme, or by introduction of nucleotide substitutions that may give rise to a different amino acid sequence. For a general description of nucleotide substitution, see, e.g., Ford et al., 1991, *Protein Expression and Purification* 2: 95-107.

Nucleic Acid Constructs

The present invention also relates to nucleic acid constructs comprising a polynucleotide of the present invention, wherein the polynucleotide is operably linked to one or more control sequences that direct the expression of the coding sequence in a suitable host cell under conditions compatible with the control sequences.

The polynucleotide may be manipulated in a variety of ways to provide for expression of the polypeptide. Manipulation of the polynucleotide prior to its insertion into a vector may be desirable or necessary depending on the expression vector. The techniques for modifying polynucleotides utilizing recombinant DNA methods are well known in the art.

The control sequence may be a promoter, a polynucleotide that is recognized by a host cell for expression of a polynucleotide encoding a polypeptide of the present invention. The promoter contains transcriptional control sequences that mediate the expression of the polypeptide. The promoter may be any polynucleotide that shows transcriptional activity in the host cell including mutant, truncated, and hybrid promoters, and may be obtained from genes encoding extracellular or intracellular polypeptides either homologous or heterologous to the host cell.

Examples of suitable promoters for directing transcription of the polynucleotide of the present invention in a bacterial host cell are the promoters obtained from the *Bacillus amyloliquefaciens* alpha-amylase gene (amyQ), *Bacillus licheniformis* alpha-amylase gene (amyL), *Bacillus licheniformis* penicillinase gene (penP), *Bacillus stearothermophilus* maltogenic amylase gene (amyM), *Bacillus subtilis* levansucrase gene (sacB), *Bacillus subtilis* xylA and xylB genes, *Bacillus thuringiensis* cryIIIA gene (Agaisse and Lereclus, 1994, *Molecular Microbiology* 13: 97-107), *E. coli* lac operon, *E. coli* trc promoter (Egon et al., 1988, *Gene* 69: 301-315), *Streptomyces coelicolor* agarase gene (dagA), and prokaryotic beta-lactamase gene (Villa-Kamaroff et al., 1978, *Proc. Natl. Acad. Sci. USA* 75: 3727-3731), as well as the tac promoter (DeBoer et al., 1983, *Proc. Natl. Acad. Sci. USA* 80: 21-25). Further promoters are described in "Useful proteins from recombinant bacteria" in Gilbert et al., 1980, *Scientific American* 242: 74-94; and in Sambrook et al., 1989, supra. Examples of tandem promoters are disclosed in WO 99/43835.

Examples of suitable promoters for directing transcription of the polynucleotide of the present invention in a filamentous fungal host cell are promoters obtained from the genes for *Aspergillus nidulans* acetamidase, *Aspergillus niger* neutral alpha-amylase, *Aspergillus niger* acid stable alpha-amylase, *Aspergillus niger* or *Aspergillus awamori* glucoamylase (glaA), *Aspergillus oryzae* TAKA amylase, *Aspergillus oryzae* alkaline protease, *Aspergillus oryzae* triose phosphate isomerase, *Fusarium oxysporum* trypsin-like protease (WO 96/00787), *Fusarium venenatum* amyloglucosidase (WO 00/56900), *Fusarium venenatum* Daria (WO 00/56900), *Fusarium venenatum* Quinn (WO 00/56900), *Rhizomucor miehei* lipase, *Rhizomucor miehei* aspartic proteinase, *Trichoderma reesei* beta-glucosidase, *Trichoderma reesei* cellobiohydrolase I, *Trichoderma reesei* cellobiohydrolase II, *Trichoderma reesei* endoglucanase I, *Trichoderma reesei* endoglucanase II, *Trichoderma reesei* endoglucanase III, *Trichoderma reesei* endoglucanase V, *Trichoderma reesei* xylanase I, *Trichoderma reesei* xylanase II, *Trichoderma reesei* xylanase III, *Trichoderma reesei* beta-xylosidase, and *Trichoderma reesei* translation elongation factor, as well as the NA2-tpi promoter (a modified promoter from an *Aspergillus* neutral alpha-amylase gene in which the untranslated leader has been replaced by an untranslated leader from an *Aspergillus* triose phosphate isomerase gene; non-limiting examples include modified promoters from an *Aspergillus niger* neutral alpha-amylase gene in which the untranslated leader has been replaced by an untranslated leader from an *Aspergillus nidulans* or *Aspergillus oryzae* triose phosphate isomerase gene); and mutant, truncated, and hybrid promoters thereof. Other promoters are described in U.S. Pat. No. 6,011,147.

In a yeast host, useful promoters are obtained from the genes for *Saccharomyces cerevisiae* enolase (ENO-1), *Saccharomyces cerevisiae* galactokinase (GAL1), *Saccharomyces cerevisiae* alcohol dehydrogenase/glyceraldehyde-3-phosphate dehydrogenase (ADH1, ADH2/GAP), *Saccharomyces cerevisiae* triose phosphate isomerase (TPI), *Saccharomyces cerevisiae* metallothionein (CUP1), and *Saccharomyces cerevisiae* 3-phosphoglycerate kinase. Other useful promoters for yeast host cells are described by Romanos et al., 1992, *Yeast* 8: 423-488.

The control sequence may also be a transcription terminator, which is recognized by a host cell to terminate transcription. The terminator is operably linked to the 3'-terminus of the polynucleotide encoding the polypeptide. Any terminator that is functional in the host cell may be used in the present invention.

Preferred terminators for bacterial host cells are obtained from the genes for *Bacillus clausii* alkaline protease (aprH), *Bacillus licheniformis* alpha-amylase (amyL), and *Escherichia coli* ribosomal RNA (rrnB).

Preferred terminators for filamentous fungal host cells are obtained from the genes for *Aspergillus nidulans* acetamidase, *Aspergillus nidulans* anthranilate synthase, *Aspergillus niger* glucoamylase, *Aspergillus niger* alpha-glucosidase, *Aspergillus oryzae* TAKA amylase, *Fusarium oxysporum* trypsin-like protease, *Trichoderma reesei* beta-glucosidase, *Trichoderma reesei* cellobiohydrolase I, *Trichoderma reesei* cellobiohydrolase II, *Trichoderma reesei* endoglucanase I, *Trichoderma reesei* endoglucanase II, *Trichoderma reesei* endoglucanase III, *Trichoderma reesei* endoglucanase V, *Trichoderma reesei* xylanase I, *Trichoderma reesei* xylanase II, *Trichoderma reesei* xylanase III, *Trichoderma reesei* beta-xylosidase, and *Trichoderma reesei* translation elongation factor.

Preferred terminators for yeast host cells are obtained from the genes for *Saccharomyces cerevisiae* enolase, *Saccharomyces cerevisiae* cytochrome C (CYC1), and *Saccharomyces cerevisiae* glyceraldehyde-3-phosphate dehydrogenase. Other useful terminators for yeast host cells are described by Romanos et al., 1992, supra.

The control sequence may also be an mRNA stabilizer region downstream of a promoter and upstream of the coding sequence of a gene which increases expression of the gene.

Examples of suitable mRNA stabilizer regions are obtained from a *Bacillus thuringiensis* cryIIIA gene (WO 94/25612) and a *Bacillus subtilis* SP82 gene (Hue et al., 1995, *J. Bacteriol.* 177: 3465-3471).

The control sequence may also be a leader, a nontranslated region of an mRNA that is important for translation by the host cell. The leader is operably linked to the 5'-terminus of the polynucleotide encoding the polypeptide. Any leader that is functional in the host cell may be used.

Preferred leaders for filamentous fungal host cells are obtained from the genes for *Aspergillus oryzae* TAKA amylase and *Aspergillus nidulans* triose phosphate isomerase.

Suitable leaders for yeast host cells are obtained from the genes for *Saccharomyces cerevisiae* enolase (ENO-1), *Saccharomyces cerevisiae* 3-phosphoglycerate kinase, *Saccharomyces cerevisiae* alpha-factor, and *Saccharomyces cerevisiae* alcohol dehydrogenase/glyceraldehyde-3-phosphate dehydrogenase (ADH2/GAP).

The control sequence may also be a polyadenylation sequence, a sequence operably linked to the 3'-terminus of the polynucleotide and, when transcribed, is recognized by the host cell as a signal to add polyadenosine residues to transcribed mRNA. Any polyadenylation sequence that is functional in the host cell may be used.

Preferred polyadenylation sequences for filamentous fungal host cells are obtained from the genes for *Aspergillus nidulans* anthranilate synthase, *Aspergillus niger* glucoamylase, *Aspergillus niger* alpha-glucosidase, *Aspergillus oryzae* TAKA amylase, and *Fusarium oxysporum* trypsin-like protease.

Useful polyadenylation sequences for yeast host cells are described by Guo and Sherman, 1995, *Mol. Cellular Biol.* 15: 5983-5990.

The control sequence may also be a signal peptide coding region that encodes a signal peptide linked to the N-terminus of a polypeptide and directs the polypeptide into the cell's secretory pathway. The 5'-end of the coding sequence of the polynucleotide may inherently contain a signal peptide coding sequence naturally linked in translation reading frame with the segment of the coding sequence that encodes the polypeptide. Alternatively, the 5'-end of the coding sequence may contain a signal peptide coding sequence that is heterologous to the coding sequence. A heterologous signal peptide coding sequence may be required where the coding sequence does not naturally contain a signal peptide coding sequence. Alternatively, a heterologous signal peptide coding sequence may simply replace the natural signal peptide coding sequence to enhance secretion of the polypeptide. However, any signal peptide coding sequence that directs the expressed polypeptide into the secretory pathway of a host cell may be used.

Effective signal peptide coding sequences for bacterial host cells are the signal peptide coding sequences obtained from the genes for *Bacillus* NCIB 11837 maltogenic amylase, *Bacillus licheniformis* subtilisin, *Bacillus licheniformis* beta-lactamase, *Bacillus stearothermophilus* alpha-amylase, *Bacillus stearothermophilus* neutral proteases (nprT, nprS, nprM), and *Bacillus subtilis* prsA. Further signal peptides are described by Simonen and Palva, 1993, *Microbiol. Rev.* 57: 109-137.

Effective signal peptide coding sequences for filamentous fungal host cells are the signal peptide coding sequences obtained from the genes for *Aspergillus niger* neutral amylase, *Aspergillus niger* glucoamylase, *Aspergillus oryzae* TAKA amylase, *Humicola insolens* cellulase, *Humicola insolens* endoglucanase V, *Humicola lanuginosa* lipase, and *Rhizomucor miehei* aspartic proteinase.

Useful signal peptides for yeast host cells are obtained from the genes for *Saccharomyces cerevisiae* alpha-factor and *Saccharomyces cerevisiae* invertase. Other useful signal peptide coding sequences are described by Romanos et al., 1992, supra.

The control sequence may also be a propeptide coding sequence that encodes a propeptide positioned at the N-terminus of a polypeptide. The resultant polypeptide is known as a proenzyme or propolypeptide (or a zymogen in some cases). A propolypeptide is generally inactive and can be converted to an active polypeptide by catalytic or autocatalytic cleavage of the propeptide from the propolypeptide. The propeptide coding sequence may be obtained from the genes for *Bacillus subtilis* alkaline protease (aprE), *Bacillus subtilis* neutral protease (nprT), *Myceliophthora thermophila* laccase (WO 95/33836), *Rhizomucor miehei* aspartic proteinase, and *Saccharomyces cerevisiae* alpha-factor.

Where both signal peptide and propeptide sequences are present, the propeptide sequence is positioned next to the N-terminus of a polypeptide and the signal peptide sequence is positioned next to the N-terminus of the propeptide sequence.

It may also be desirable to add regulatory sequences that regulate expression of the polypeptide relative to the growth of the host cell. Examples of regulatory sequences are those that cause expression of the gene to be turned on or off in response to a chemical or physical stimulus, including the presence of a regulatory compound. Regulatory sequences in prokaryotic systems include the lac, tac, and trp operator systems. In yeast, the ADH2 system or GAL1 system may be used. In filamentous fungi, the *Aspergillus niger* glucoamylase promoter, *Aspergillus oryzae* TAKA alpha-amylase promoter, and *Aspergillus oryzae* glucoamylase promoter, *Trichoderma reesei* cellobiohydrolase I promoter, and *Trichoderma reesei* cellobiohydrolase II promoter may be used. Other examples of regulatory sequences are those that allow for gene amplification. In eukaryotic systems, these regulatory sequences include the dihydrofolate reductase gene that is amplified in the presence of methotrexate, and the metallothionein genes that are amplified with heavy metals. In these cases, the polynucleotide encoding the polypeptide would be operably linked to the regulatory sequence.

Expression Vectors

The present invention also relates to recombinant expression vectors comprising a polynucleotide of the present invention, a promoter, and transcriptional and translational stop signals. The various nucleotide and control sequences may be joined together to produce a recombinant expression vector that may include one or more convenient restriction sites to allow for insertion or substitution of the polynucleotide encoding the polypeptide at such sites. Alternatively, the polynucleotide may be expressed by inserting the polynucleotide or a nucleic acid construct comprising the polynucleotide into an appropriate vector for expression. In creating the expression vector, the coding sequence is located in the vector so that the coding sequence is operably linked with the appropriate control sequences for expression.

The recombinant expression vector may be any vector (e.g., a plasmid or virus) that can be conveniently subjected to recombinant DNA procedures and can bring about expression of the polynucleotide. The choice of the vector will typically depend on the compatibility of the vector with the host cell into which the vector is to be introduced. The vector may be a linear or closed circular plasmid.

The vector may be an autonomously replicating vector, i.e., a vector that exists as an extrachromosomal entity, the replication of which is independent of chromosomal replication, e.g., a plasmid, an extrachromosomal element, a minichromosome, or an artificial chromosome. The vector may contain any means for assuring self-replication. Alternatively, the vector may be one that, when introduced into the host cell, is integrated into the genome and replicated together with the chromosome(s) into which it has been integrated. Furthermore, a single vector or plasmid or two or more vectors or plasmids that together contain the total DNA to be introduced into the genome of the host cell, or a transposon, may be used.

The vector preferably contains one or more selectable markers that permit easy selection of transformed, transfected, transduced, or the like cells. A selectable marker is a gene the product of which provides for biocide or viral resistance, resistance to heavy metals, prototrophy to auxotrophs, and the like.

Examples of bacterial selectable markers are *Bacillus licheniformis* or *Bacillus subtilis* dal genes, or markers that confer antibiotic resistance such as ampicillin, chloramphenicol, kanamycin, neomycin, spectinomycin, or tetracycline resistance. Suitable markers for yeast host cells include, but are not limited to, ADE2, HIS3, LEU2, LYS2, MET3, TRP1, and URA3. Selectable markers for use in a filamentous fungal host cell include, but are not limited to, adeA (phosphoribosylaminoimidazole-succinocarboxamide synthase), adeB (phosphoribosylaminoimidazole synthase), amdS (acetamidase), argB (ornithine carbamoyltransferase), bar (phosphinothricin acetyltransferase), hph (hygromycin phosphotransferase), niaD (nitrate reductase), pyrG (orotidine-5'-phosphate decarboxylase), sC (sulfate adenyltransferase), and trpC (anthranilate synthase), as well as equivalents thereof. Preferred for use in an *Aspergillus* cell are *Aspergillus nidulans* or *Aspergillus oryzae* amdS and pyrG genes and a *Streptomyces hygroscopicus* bar gene. Preferred for use in a *Trichoderma* cell are adeA, adeB, amdS, hph, and pyrG genes.

The selectable marker may be a dual selectable marker system as described in WO 2010/039889. In one aspect, the dual selectable marker is a hph-tk dual selectable marker system.

The vector preferably contains an element(s) that permits integration of the vector into the host cell's genome or autonomous replication of the vector in the cell independent of the genome.

For integration into the host cell genome, the vector may rely on the polynucleotide's sequence encoding the polypeptide or any other element of the vector for integration into the genome by homologous or non-homologous recombination. Alternatively, the vector may contain additional polynucleotides for directing integration by homologous recombination into the genome of the host cell at a precise location(s) in the chromosome(s). To increase the likelihood of integration at a precise location, the integrational elements should contain a sufficient number of nucleic acids, such as 100 to 10,000 base pairs, 400 to 10,000 base pairs, and 800 to 10,000 base pairs, which have a high degree of sequence identity to the corresponding target sequence to enhance the probability of homologous recombination. The integrational elements may be any sequence that is homologous with the target sequence in the genome of the host cell. Furthermore, the integrational elements may be non-encoding or encoding polynucleotides. On the other hand, the vector may be integrated into the genome of the host cell by non-homologous recombination.

For autonomous replication, the vector may further comprise an origin of replication enabling the vector to replicate autonomously in the host cell in question. The origin of replication may be any plasmid replicator mediating autonomous replication that functions in a cell. The term "origin of replication" or "plasmid replicator" means a polynucleotide that enables a plasmid or vector to replicate in vivo.

Examples of bacterial origins of replication are the origins of replication of plasmids pBR322, pUC19, pACYC177, and pACYC184 permitting replication in *E. coli*, and pUB110, pE194, pTA1060, and pAMß1 permitting replication in *Bacillus*.

Examples of origins of replication for use in a yeast host cell are the 2 micron origin of replication, ARS1, ARS4, the combination of ARS1 and CEN3, and the combination of ARS4 and CEN6.

Examples of origins of replication useful in a filamentous fungal cell are AMA1 and ANS1 (Gems et al., 1991, *Gene* 98: 61-67; Cullen et al., 1987, *Nucleic Acids Res.* 15: 9163-9175; WO 00/24883). Isolation of the AMA1 gene and construction of plasmids or vectors comprising the gene can be accomplished according to the methods disclosed in WO 00/24883.

More than one copy of a polynucleotide of the present invention may be inserted into a host cell to increase production of a polypeptide. An increase in the copy number of the polynucleotide can be obtained by integrating at least one additional copy of the sequence into the host cell genome or by including an amplifiable selectable marker gene with the polynucleotide where cells containing amplified copies of the selectable marker gene, and thereby additional copies of the polynucleotide, can be selected for by cultivating the cells in the presence of the appropriate selectable agent.

The procedures used to ligate the elements described above to construct the recombinant expression vectors of the present invention are well known to one skilled in the art (see, e.g., Sambrook et al., 1989, supra).

Host Cells

The present invention also relates to recombinant host cells, comprising a polynucleotide of the present invention operably linked to one or more control sequences that direct the production of a polypeptide of the present invention. A construct or vector comprising a polynucleotide is introduced into a host cell so that the construct or vector is maintained as a chromosomal integrant or as a self-replicating extra-chromosomal vector as described earlier. The choice of a host cell will to a large extent depend upon the gene encoding the polypeptide and its source.

In some embodiments, the polypeptide is heterologous to the recombinant host cell.

In some embodiments, at least one of the one or more control sequences is heterologous to the polynucleotide encoding the polypeptide.

In some embodiments, the recombinant host cell comprises at least two copies, e.g., three, four, or five, of the polynucleotide of the present invention.

The host cell may be any microbial or plant cell useful in the recombinant production of a polypeptide of the present invention, e.g., a prokaryotic cell or a fungal cell.

The prokaryotic host cell may be any Gram-positive or Gram-negative bacterium. Gram-positive bacteria include, but are not limited to, *Bacillus, Clostridium, Enterococcus, Geobacillus, Lactobacillus, Lactococcus, Oceanobacillus, Staphylococcus, Streptococcus*, and *Streptomyces*. Gram-negative bacteria include, but are not limited to, *Campylobacter, E. coli, Flavobacterium, Fusobacterium, Helicobacter, Ilyobacter, Neisseria, Pseudomonas, Salmonella*, and *Ureaplasma*.

The bacterial host cell may be any *Bacillus* cell including, but not limited to, *Bacillus alkalophilus, Bacillus amyloliquefaciens, Bacillus brevis, Bacillus circulans, Bacillus clausii, Bacillus coagulans, Bacillus firmus, Bacillus lautus, Bacillus lentus, Bacillus licheniformis, Bacillus megaterium, Bacillus pumilus, Bacillus stearothermophilus, Bacillus subtilis*, and *Bacillus thuringiensis* cells.

The bacterial host cell may also be any *Streptococcus* cell including, but not limited to, *Streptococcus equisimilis, Streptococcus pyogenes, Streptococcus uberis*, and *Streptococcus equi* subsp. *Zooepidemicus* cells.

The bacterial host cell may also be any *Streptomyces* cell including, but not limited to, *Streptomyces achromogenes, Streptomyces avermitilis, Streptomyces coelicolor, Streptomyces griseus*, and *Streptomyces lividans* cells.

In an embodiment, the host cell comprises an *Aspergillus* host cell. In an embodiment, the host cell comprises an *Aspergillus oryzae* host cell.

The introduction of DNA into a *Bacillus* cell may be effected by protoplast transformation (see, e.g., Chang and Cohen, 1979, *Mol. Gen. Genet.* 168: 111-115), competent cell transformation (see, e.g., Young and Spizizen, 1961, *J. Bacteriol.* 81: 823-829, or Dubnau and Davidoff-Abelson, 1971, *J. Mol. Biol.* 56: 209-221), electroporation (see, e.g., Shigekawa and Dower, 1988, *Biotechniques* 6: 742-751), or conjugation (see, e.g., Koehler and Thorne, 1987, *J. Bacteriol.* 169: 5271-5278). The introduction of DNA into an *E. coli* cell may be effected by protoplast transformation (see, e.g., Hanahan, 1983, *J. Mol. Biol.* 166: 557-580) or electroporation (see, e.g., Dower et al., 1988, *Nucleic Acids Res.* 16: 6127-6145). The introduction of DNA into a *Streptomyces* cell may be effected by protoplast transformation, electroporation (see, e.g., Gong et al., 2004, *Folia Microbiol.* (*Praha*) 49: 399-405), conjugation (see, e.g., Mazodier et al., 1989, *J. Bacteriol.* 171: 3583-3585), or transduction (see, e.g., Burke et al., 2001, *Proc. Natl. Acad. Sci. USA* 98: 6289-6294). The introduction of DNA into a *Pseudomonas* cell may be effected by electroporation (see, e.g., Choi et al., 2006, *J. Microbiol. Methods* 64: 391-397) or conjugation (see, e.g., Pinedo and Smets, 2005, *Appl. Environ. Microbiol.* 71: 51-57). The introduction of DNA into a *Streptococcus* cell may be effected by natural competence (see, e.g., Perry and Kuramitsu, 1981, *Infect. Immun.* 32: 1295-1297), protoplast transformation (see, e.g., Catt and Jollick, 1991, *Microbios* 68: 189-207), electroporation (see, e.g., Buckley et al., 1999, *Appl. Environ. Microbiol.* 65: 3800-3804), or conjugation (see, e.g., Clewell, 1981, *Microbiol. Rev.* 45: 409-436). However, any method known in the art for introducing DNA into a host cell can be used.

The host cell may be a fungal cell. "Fungi" as used herein includes the phyla Ascomycota, Basidiomycota, Chytridiomycota, and Zygomycota as well as the Oomycota and all mitosporic fungi (as defined by Hawksworth et al., In, *Ainsworth and Bisby's Dictionary of The Fungi*, 8th edition, 1995, CAB International, University Press, Cambridge, UK).

The fungal host cell may be a yeast cell. "Yeast" as used herein includes ascosporogenous yeast (Endomycetales), basidiosporogenous yeast, and yeast belonging to the Fungi Imperfecti (Blastomycetes). Since the classification of yeast may change in the future, for the purposes of this invention, yeast shall be defined as described in *Biology and Activities of Yeast* (Skinner, Passmore, and Davenport, editors, *Soc. App. Bacteriol. Symposium Series* No. 9, 1980).

The yeast host cell may be a *Candida, Hansenula, Kluyveromyces, Pichia, Saccharomyces, Schizosaccharomyces*, or *Yarrowia* cell, such as a *Kluyveromyces lactis, Saccharomyces carlsbergensis, Saccharomyces cerevisiae, Saccharomyces diastaticus, Saccharomyces douglasii, Saccharomyces kluyveri, Saccharomyces norbensis, Saccharomyces oviformis*, or *Yarrowia lipolytica* cell.

The fungal host cell may be a filamentous fungal cell. "Filamentous fungi" include all filamentous forms of the subdivision Eumycota and Oomycota (as defined by Hawksworth et al., 1995, supra). The filamentous fungi are generally characterized by a mycelial wall composed of chitin, cellulose, glucan, chitosan, mannan, and other complex polysaccharides. Vegetative growth is by hyphal elongation and carbon catabolism is obligately aerobic. In contrast, vegetative growth by yeasts such as *Saccharomyces cerevisiae* is by budding of a unicellular thallus and carbon catabolism may be fermentative.

The filamentous fungal host cell may be an *Acremonium, Aspergillus, Aureobasidium, Bjerkandera, Ceriporiopsis, Chrysosporium, Coprinus, Coriolus, Cryptococcus, Filibasidium, Fusarium, Humicola, Magnaporthe, Mucor, Myceliophthora, Neocallimastix, Neurospora, Paecilomyces, Penicillium, Phanerochaete, Phlebia, Piromyces, Pleurotus, Schizophyllum, Talaromyces, Thermoascus, Thielavia, Tolypocladium, Trametes*, or *Trichoderma* cell.

For example, the filamentous fungal host cell may be an *Aspergillus awamori, Aspergillus foetidus, Aspergillus fumigatus, Aspergillus japonicus, Aspergillus nidulans, Aspergillus niger, Aspergillus oryzae, Bjerkandera adusta, Ceriporiopsis aneirina, Ceriporiopsis caregiea, Ceriporiopsis gilvescens, Ceriporiopsis pannocinta, Ceriporiopsis rivulosa, Ceriporiopsis subrufa, Ceriporiopsis subvermispora, Chrysosporium inops, Chrysosporium keratinophilum, Chrysosporium lucknowense, Chrysosporium merdarium, Chrysosporium pannicola, Chrysosporium queenslandicum, Chrysosporium tropicum, Chrysosporium zonatum, Coprinus cinereus, Coriolus hirsutus, Fusarium bactridioides, Fusarium cerealis, Fusarium crookwellense, Fusarium culmorum, Fusarium graminearum, Fusarium graminum, Fusarium heterosporum, Fusarium negundi, Fusarium oxysporum, Fusarium reticulatum, Fusarium roseum, Fusarium sambucinum, Fusarium sarcochroum, Fusarium sporotrichioides, Fusarium sulphureum, Fusarium torulosum, Fusarium trichothecioides, Fusarium venenatum, Humicola insolens, Humicola lanuginosa, Mucor miehei, Myceliophthora thermophila, Neurospora crassa, Penicillium purpurogenum, Phanerochaete chrysosporium, Phlebia radiata, Pleurotus eryngii, Talaromyces emersonii, Thielavia terrestris, Trametes villosa, Trametes versicolor, Trichoderma harzianum, Trichoderma koningii, Trichoderma longibrachiatum, Trichoderma reesei*, or *Trichoderma viride* cell.

Fungal cells may be transformed by a process involving protoplast formation, transformation of the protoplasts, and regeneration of the cell wall in a manner known per se. Suitable procedures for transformation of *Aspergillus* and *Trichoderma* host cells are described in EP 238023, Yelton et al., 1984, *Proc. Natl. Acad. Sci. USA* 81: 1470-1474, and Christensen et al., 1988, *Bio/Technology* 6: 1419-1422. Suitable methods for transforming *Fusarium* species are described by Malardier et al., 1989, *Gene* 78: 147-156, and WO 96/00787. Yeast may be transformed using the procedures described by Becker and Guarente, In Abelson, J. N. and Simon, M. I., editors, *Guide to Yeast Genetics and Molecular Biology, Methods in Enzymology*, Volume 194, pp 182-187, Academic Press, Inc., New York; Ito et al., 1983, *J. Bacteriol.* 153: 163; and Hinnen et al., 1978, *Proc. Natl. Acad. Sci. USA* 75: 1920.

Methods of Production

The present invention also relates to methods of producing a polypeptide of the present invention, comprising (a) cultivating a cell, which in its wild-type form produces the polypeptide, under conditions conducive for production of the polypeptide; and optionally, (b) recovering the polypeptide. In one aspect, the cell is a *Aspergillus, Thermoascus, Talaromyces, Thielavia, Penicillium*, and/or *Colletotrichum* cell. In another aspect, the cell is a *Aspergillus niger, Aspergillus aculeatus, Aspergillus luchuensis, Aspergillus oryzae, Thermoascus crustaceus, Talaromyces leycettanus, Talaromyces calidicanius, Thielavia hyrcaniae, Penicillium* sp. XY2495, *Penicillium* sp. 54788 and/or *Colletotrichum gloeosporioides* cell.

The present invention also relates to methods of producing a polypeptide of the present invention, comprising (a) cultivating a recombinant host cell of the present invention under conditions conducive for production of the polypeptide; and optionally, (b) recovering the polypeptide.

The host cells are cultivated in a nutrient medium suitable for production of the polypeptide using methods known in the art. For example, the cells may be cultivated by shake flask cultivation, or small-scale or large-scale fermentation (including continuous, batch, fed-batch, or solid-state fermentations) in laboratory or industrial fermentors in a suitable medium and under conditions allowing the polypeptide to be expressed and/or isolated. The cultivation takes place in a suitable nutrient medium comprising carbon and nitrogen sources and inorganic salts, using procedures known in the art. Suitable media are available from commercial suppliers or may be prepared according to published compositions (e.g., in catalogues of the American Type Culture Collection). If the polypeptide is secreted into the nutrient medium, the polypeptide can be recovered directly from the medium. If the polypeptide is not secreted, it can be recovered from cell lysates.

The polypeptide may be detected using methods known in the art that are specific for the polypeptides. These detection methods include, but are not limited to, use of specific antibodies, formation of an enzyme product, or disappearance of an enzyme substrate. For example, an enzyme assay may be used to determine the activity of the polypeptide The polypeptide may be recovered using methods known in the art. For example, the polypeptide may be recovered from the fermentation medium by conventional procedures including, but not limited to, collection, centrifugation, filtration, extraction, spray-drying, evaporation, or precipitation. In one aspect, a whole fermentation broth comprising the polypeptide is recovered.

The polypeptide may be purified by a variety of procedures known in the art including, but not limited to, chromatography (e.g., ion exchange, affinity, hydrophobic, chromatofocusing, and size exclusion), electrophoretic procedures (e.g., preparative isoelectric focusing), differential solubility (e.g., ammonium sulfate precipitation), SDS-PAGE, or extraction (see, e.g., *Protein Purification*, Janson and Ryden, editors, VCH Publishers, New York, 1989) to obtain substantially pure polypeptides.

Pectinase Granules

The present invention also relates to enzyme granules/particles comprising the pectinases of the invention. The enzyme granules/particles may comprise a polypeptide having pectinase activity (e.g., a polygalacturonase from the GH28 family, a rhamnogalacturonase, from the GH28 family, a pectin methyl esterase from the CE8 family, a pectin lyase from the PL1 family, a pectin acetyl esterase from the CE12 family or CE16 family, a rhamnogalacturonan lyase from the PL4 family, a beta-galactanase from the GH53 family, and combinations thereof). In an embodiment, the granule comprises a core, and optionally one or more coatings (outer layers) surrounding the core.

The core may have a diameter, measured as equivalent spherical diameter (volume based average particle size), of 20-2000 μm, particularly 50-1500 μm, 100-1500 μm or 250-1200 μm.

In an embodiment, the core comprises one or more polypeptides having pectinase activity (e.g., polygalacturonase activity, rhamnogalacturonase activity, pectin methyl esterase, pectin lyase activity, pectin acetyl esterase activity, rhamnogalacturonan lyase activity, beta-galactanase activity, etc.) of the present invention. In an embodiment, the core comprises one or more polypeptides having polygalacturonase activity of the present invention. In an embodiment, the core comprises one or more polypeptides having rhamnogalacturonase activity of the present invention. In an embodiment, the core comprises one or more polypeptides having pectin methyl esterase activity of the present invention. In an embodiment, the core comprises one or more polypeptides having pectin lyase activity of the present invention. In an embodiment, the core comprises one or more polypeptides having pectin acetyl esterase activity of the present invention. In an embodiment, the core comprises one or more polypeptides having rhamnogalacturonan lyase activity of the present invention. In an embodiment, the core comprises one or more polypeptides having beta-galactanase activity of the present invention.

The core may include additional materials such as fillers, fiber materials (cellulose or synthetic fibers), stabilizing agents, solubilizing agents, suspension agents, viscosity regulating agents, light spheres, plasticizers, salts, lubricants and fragrances.

The core may include a binder, such as synthetic polymer, wax, fat, or carbohydrate.

The core may include a salt of a multivalent cation, a reducing agent, an antioxidant, a peroxide decomposing catalyst and/or an acidic buffer component, typically as a homogenous blend.

The core may include an inert particle with the enzyme absorbed into it, or applied onto the surface, e.g., by fluid bed coating.

The core may have a diameter of 20-2000 μm, particularly 50-1500 μm, 100-1500 μm or 250-1200 μm.

The core may be surrounded by at least one coating, e.g., to improve the storage stability, to reduce dust formation during handling, or for coloring the granule. The optional coating(s) may include a salt coating, or other suitable coating materials, such as polyethylene glycol (PEG), methyl hydroxy-propyl cellulose (MHPC) and polyvinyl alcohol (PVA).

The coating may be applied in an amount of at least 0.1% by weight of the core, e.g., at least 0.5%, at least 1%, at least 5%, at least 10%, or at least 15%. The amount may be at most 100%, 70%, 50%, 40% or 30%.

The coating is preferably at least 0.1 μm thick, particularly at least 0.5 μm, at least 1 μm or at least 5 μm. In some embodiments, the thickness of the coating is below 100 μm, such as below 60 μm, or below 40 μm.

The coating should encapsulate the core unit by forming a substantially continuous layer. A substantially continuous layer is to be understood as a coating having few or no holes, so that the core unit it is encapsulating/enclosing has few or none uncoated areas. The layer or coating should, in particular, be homogeneous in thickness.

The coating can further contain other materials as known in the art, e.g., fillers, antisticking agents, pigments, dyes, plasticizers and/or binders, such as titanium dioxide, kaolin, calcium carbonate or talc.

A salt coating may comprise at least 60% by weight of a salt, e.g., at least 65%, at least 70%, at least 75%, at least 80%, at least 85%, at least 90%, at least 95% or at least 99% by weight.

To provide acceptable protection, the salt coating is preferably at least 0.1 μm thick, e.g., at least 0.5 μm, at least 1 μm, at least 2 μm, at least 4 μm, at least 5 μm, or at least 8 μm. In a particular embodiment, the thickness of the salt coating is below 100 μm, such as below 60 μm, or below 40 μm.

The salt may be added from a salt solution where the salt is completely dissolved or from a salt suspension wherein the fine particles are less than 50 μm, such as less than 10 μm or less than 5 μm.

The salt coating may comprise a single salt or a mixture of two or more salts. The salt may be water soluble, in particular, having a solubility at least 0.1 g in 100 g of water at 20° C., preferably at least 0.5 g per 100 g water, e.g., at least 1 g per 100 g water, e.g., at least 5 g per 100 g water.

The salt may be an inorganic salt, e.g., salts of sulfate, sulfite, phosphate, phosphonate, nitrate, chloride or carbonate or salts of simple organic acids (less than 10 carbon atoms, e.g., 6 or less carbon atoms) such as citrate, malonate or acetate. Examples of cations in these salts are alkali or earth alkali metal ions, the ammonium ion or metal ions of the first transition series, such as sodium, potassium, magnesium, calcium, zinc or aluminum. Examples of anions include chloride, bromide, iodide, sulfate, sulfite, bisulfite, thiosulfate, phosphate, monobasic phosphate, dibasic phosphate, hypophosphite, dihydrogen pyrophosphate, tetraborate, borate, carbonate, bicarbonate, metasilicate, citrate, malate, maleate, malonate, succinate, lactate, formate, acetate, butyrate, propionate, benzoate, tartrate, ascorbate or gluconate. In particular, alkali- or earth alkali metal salts of sulfate, sulfite, phosphate, phosphonate, nitrate, chloride or carbonate or salts of simple organic acids such as citrate, malonate or acetate may be used.

The salt in the coating may have a constant humidity at 20° C. above 60%, particularly above 70%, above 80% or above 85%, or it may be another hydrate form of such a salt (e.g., anhydrate). The salt coating may be as described in WO 00/01793 or WO 2006/034710. Specific examples of suitable salts are NaCl ($CH_{20^\circ C.}$=76%), $Na_2CO_3$ ($CH_{20^\circ C.}$=92%), $NaNO_3$ ($CH_{20^\circ C.}$=73%), $Na_2HPO_4$ ($CH_{20^\circ C.}$=95%), $Na_3PO_4$ ($CH_{25^\circ C.}$=92%), $NH_4Cl$ ($CH_{20^\circ C.}$=79.5%), $(NH_4)_2HPO_4$ ($CH_{20^\circ C.}$=93.0%), $NH_4H_2PO_4$ ($CH_{20^\circ C.}$=93.1%), $(NH_4)_2SO_4$ ($CH_{20^\circ C.}$=81.1%), KCl ($CH_{20^\circ C.}$=85%), $K_2HPO_4$ ($CH_{20^\circ C.}$=92%), $KH_2PO_4$ ($CH_{20^\circ C.}$=96.5%), $KNO_3$ ($CH_{20^\circ C.}$=93.5%), $Na_2SO_4$ ($CH_{20^\circ C.}$=93%), $K_2SO_4$ ($CH_{20^\circ C.}$=98%), $KHSO_4$ ($CH_{20^\circ C.}$=86%), $MgSO_4$ ($CH_{20^\circ C.}$=90%), $ZnSO_4$ ($CH_{20^\circ C.}$=90%) and sodium citrate ($CH_{25^\circ C.}$=86%). Other examples include $NaH_2PO_4$, $(NH_4)H_2PO_4$, $CuSO_4$, $Mg(NO_3)_2$ and magnesium acetate.

The salt may be in anhydrous form, or it may be a hydrated salt, i.e. a crystalline salt hydrate with bound water(s) of crystallization, such as described in WO 99/32595. Specific examples include anhydrous sodium sulfate ($Na_2SO_4$), anhydrous magnesium sulfate ($MgSO_4$), magnesium sulfate heptahydrate ($MgSO_4 \cdot 7H_2O$), zinc sulfate heptahydrate ($ZnSO_4 \cdot 7H_2O$), sodium phosphate dibasic heptahydrate ($Na_2HPO_4 \cdot 7H_2O$), magnesium nitrate hexahydrate ($Mg(NO_3)_2(6H_2O)$), sodium citrate dihydrate and magnesium acetate tetrahydrate.

Preferably the salt is applied as a solution of the salt, e.g., using a fluid bed.

The coating materials can be waxy coating materials and film-forming coating materials. Examples of waxy coating materials are poly(ethylene oxide) products (polyethyleneglycol, PEG) with mean molar weights of 1000 to 20000; ethoxylated nonylphenols having from 16 to 50 ethylene oxide units; ethoxylated fatty alcohols in which the alcohol contains from 12 to 20 carbon atoms and in which there are 15 to 80 ethylene oxide units; fatty alcohols; fatty acids; and mono- and di- and triglycerides of fatty acids. Examples of film-forming coating materials suitable for application by fluid bed techniques are given in GB 1483591.

The granule may optionally have one or more additional coatings. Examples of suitable coating materials are polyethylene glycol (PEG), methyl hydroxy-propyl cellulose (MHPC) and polyvinyl alcohol (PVA). Examples of enzyme granules with multiple coatings are described in WO 93/07263 and WO 97/23606.

The core can be prepared by granulating a blend of the ingredients, e.g., by a method comprising granulation techniques such as crystallization, precipitation, pan-coating, fluid bed coating, fluid bed agglomeration, rotary atomization, extrusion, prilling, spheronization, size reduction methods, drum granulation, and/or high shear granulation.

Methods for preparing the core can be found in the Handbook of Powder Technology; Particle size enlargement by C. E. Capes; Volume 1; 1980; Elsevier. Preparation methods include known feed and granule formulation technologies, e.g.:

(a) Spray dried products, wherein a liquid enzyme-containing solution is atomized in a spray drying tower to form small droplets which during their way down the drying tower dry to form an enzyme-containing particulate material. Very small particles can be produced this way (Michael S. Showell (editor); *Powdered detergents*; Surfactant Science Series; 1998; vol. 71; page 140-142; Marcel Dekker).

(b) Layered products, wherein the enzyme is coated as a layer around a pre-formed inert core particle, wherein an enzyme-containing solution is atomized, typically in a fluid bed apparatus wherein the pre-formed core particles are fluidized, and the enzyme-containing solution adheres to the core particles and dries up to leave a layer of dry enzyme on the surface of the core particle. Particles of a desired size can be obtained this way if a useful core particle of the desired size can be found. This type of product is described in, e.g., WO 97/23606.

(c) Absorbed core particles, wherein rather than coating the enzyme as a layer around the core, the enzyme is absorbed onto and/or into the surface of the core. Such a process is described in WO 97/39116.

(d) Extrusion or pelletized products, wherein an enzyme-containing paste is pressed to pellets or under pressure is extruded through a small opening and cut into particles which are subsequently dried. Such particles usually have a considerable size because of the material in which the extrusion opening is made (usually a plate with bore holes) sets a limit on the allowable pressure drop over the extrusion opening. Also, very high extrusion pressures when using a small opening increase heat generation in the enzyme paste, which is harmful to the enzyme (Michael S. Showell (editor); *Powdered detergents*; Surfactant Science Series; 1998; vol. 71; pages 140-142; Marcel Dekker).

(e) Prilled products, wherein an enzyme-containing powder is suspended in molten wax and the suspension is sprayed, e.g., through a rotating disk atomizer, into a cooling chamber where the droplets quickly solidify (Michael S. Showell (editor); *Powdered detergents*; Surfactant Science Series; 1998; vol. 71; page 140-142; Marcel Dekker). The product obtained is one wherein the enzyme is uniformly distributed throughout an inert material instead of being concentrated on its surface. U.S. Pat. Nos. 4,016,040 and 4,713,245 describe this technique.

(f) Mixer granulation products, wherein an enzyme-containing liquid is added to a dry powder composition of conventional granulating components. The liquid and the powder in a suitable proportion are mixed and as the moisture of the liquid is absorbed in the dry powder, the components of the dry powder will start to adhere and agglomerate and particles will build up, forming granulates comprising the enzyme. Such a process is described in U.S. Pat. No. 4,106,991 and related documents EP 170360, EP 304332, EP 304331, WO 90/09440 and WO 90/09428. In a particular product of this process, various high-shear mixers can be used as granulators. Granulates consisting of enzyme, fillers and binders etc. are mixed with cellulose fibers to reinforce the particles to produce a so-called T-granulate. Reinforced particles, are more robust, and release less enzymatic dust.

(g) Size reduction, wherein the cores are produced by milling or crushing of larger particles, pellets, tablets, briquettes etc. containing the enzyme. The wanted core particle fraction is obtained by sieving the milled or crushed product. Over and undersized particles can be recycled. Size reduction is described in Martin Rhodes (editor); Principles of Powder Technology; 1990; Chapter 10; John Wiley & Sons.

(h) Fluid bed granulation. Fluid bed granulation involves suspending particulates in an air stream and spraying a liquid onto the fluidized particles via nozzles. Particles hit by spray droplets get wetted and become tacky. The tacky particles collide with other particles and adhere to them to form a granule.

(i) The cores may be subjected to drying, such as in a fluid bed drier. Other known methods for drying granules in the feed or enzyme industry can be used by the skilled person. The drying preferably takes place at a product temperature of from 25 to 90° C. For some enzymes, it is important the cores comprising the enzyme contain a low amount of water before coating with the salt. If water sensitive enzymes are coated with a salt before excessive water is removed, it will be trapped within the core and may affect the activity of the enzyme negatively. After drying, the cores preferably contain 0.1-10% w/w water.

Non-dusting granulates may be produced, e.g., as disclosed in U.S. Pat. Nos. 4,106,991 and 4,661,452 and may optionally be coated by methods known in the art.

The granulate may further one or more additional enzymes. Each enzyme will then be present in more granules securing a more uniform distribution of the enzymes, and also reduces the physical segregation of different enzymes due to different particle sizes. Methods for producing multi-enzyme co-granulates is disclosed in the ip.com disclosure IPCOM000200739D. Another example of formulation of enzymes by the use of co-granulates is disclosed in WO 2013/188331.

The present invention also relates to protected enzymes prepared according to the method disclosed in EP 238,216.

In an embodiment, the granule further comprises one or more additional enzymes, e.g., hydrolase, isomerase, ligase, lyase, oxidoreductase, and transferase. The one or more additional enzymes are preferably selected from the group consisting of acetylxylan esterase, acylglycerol lipase, amylase, alpha-amylase, beta-amylase, arabinofuranosidase, cellobiohydrolases, cellulase, feruloyl esterase, galactanase, alpha-galactosidase, beta-galactosidase, beta-glucanase, beta-glucosidase, lysophospholipase, lysozyme, alpha-mannosidase, beta-mannosidase (mannanase), phytase, phospholipase A1, phospholipase A2, phospholipase D, protease, pullulanase, pectin esterase, triacylglycerol lipase, xylanase, beta-xylosidase or any combination thereof.

Liquid Formulations

The present invention also relates to liquid compositions comprising the pectinases (e.g., polygalacturonases, rhamnogalacturonases, pectin methyl esterases, pectin lyases, pectin acetyl esterases, rhamnogalacturonan lyases, beta-galactanases, etc.) of the invention. The liquid compositions may comprise a polypeptide having pectinase activity (e.g., a polygalacturonase from the GH28 family, a rhamnogalacturonase, from the GH28 family, a pectin methyl esterase from the CE8 family, a pectin lyase from the PL1 family, a pectin acetyl esterase from the CE12 family or CE16 family, a rhamnogalacturonan lyase from the PL4 family, a beta-galactanase from the GH53 family, and combinations thereof). The composition may comprise an enzyme stabilizer (examples of which include polyols such as propylene glycol or glycerol, sugar or sugar alcohol, lactic acid, reversible protease inhibitor, boric acid, or a boric acid derivative, e.g., an aromatic borate ester, or a phenyl boronic acid derivative such as 4-formylphenyl boronic acid).

In some embodiments, filler(s) or carrier material(s) are included to increase the volume of such compositions. Suitable filler or carrier materials include, but are not limited to, various salts of sulfate, carbonate and silicate as well as talc, clay and the like. Suitable filler or carrier materials for liquid compositions include, but are not limited to water or low molecular weight primary and secondary alcohols including polyols and diols. Examples of such alcohols include, but are not limited to, methanol, ethanol, propanol and isopropanol. In some embodiments, the compositions contain from about 5% to about 90% of such materials.

In an aspect, the present invention relates to liquid formulations comprising:

(A) 0.001% to 25% w/w of one or more polypeptides having pectinase activity (e.g., polygalacturonase activity, rhamnogalacturonase activity, pectin methyl esterase, pectin lyase activity, pectin acetyl esterase activity, rhamnogalacturonan lyase activity, beta-galactanase activity, etc.) of the present invention; and (B) water.

In another embodiment, the liquid formulation comprises 20% to 80% w/w of polyol. In one embodiment, the liquid formulation comprises 0.001% to 2.0% w/w preservative.

In another embodiment, the invention relates to liquid formulations comprising:

(A) 0.001% to 25% w/w of one or more polypeptides having pectinase activity (e.g., polygalacturonase activity, rhamnogalacturonase activity, pectin methyl esterase, pectin lyase activity, pectin acetyl esterase activity, rhamnogalacturonan lyase activity, beta-galactanase activity, etc.) of the present invention;

(B) 20% to 80% w/w of polyol;

(C) optionally 0.001% to 2.0% w/w preservative; and (D) water.

In another embodiment, the invention relates to liquid formulations comprising:

(A) 0.001% to 25% w/w of one or more polypeptides having pectinase activity (e.g., polygalacturonase activity, rhamnogalacturonase activity, pectin methyl esterase, pectin lyase activity, pectin acetyl esterase activity, rhamnogalacturonan lyase activity, beta-galactanase activity, etc.) of the present invention;

(B) 0.001% to 2.0% w/w preservative;

(C) optionally 20% to 80% w/w of polyol; and (D) water.

In another embodiment, the liquid formulation comprises one or more formulating agents, such as a formulating agent selected from the group consisting of polyol, sodium chloride, sodium benzoate, potassium sorbate, sodium sulfate, potassium sulfate, magnesium sulfate, sodium thiosulfate, calcium carbonate, sodium citrate, dextrin, glucose, sucrose, sorbitol, lactose, starch, PVA, acetate and phosphate, preferably selected from the group consisting of sodium sulfate, dextrin, cellulose, sodium thiosulfate, kaolin and calcium carbonate. In one embodiment, the polyols is selected from the group consisting of glycerol, sorbitol, propylene glycol (MPG), ethylene glycol, diethylene glycol, triethylene glycol, 1,2-propylene glycol or 1,3-propylene glycol, dipropylene glycol, polyethylene glycol (PEG) having an average molecular weight below about 600 and polypropylene glycol (PPG) having an average molecular weight below about 600, more preferably selected from the group consisting of glycerol, sorbitol and propylene glycol (MPG) or any combination thereof.

In another embodiment, the liquid formulation comprises 20%-80% polyol (i.e., total amount of polyol), e.g., 25%-75% polyol, 30%-70% polyol, 35%-65% polyol, or 40%-60% polyol. In one embodiment, the liquid formulation comprises 20%-80% polyol, e.g., 25%-75% polyol, 30%-70% polyol, 35%-65% polyol, or 40%-60% polyol, wherein the polyol is selected from the group consisting of glycerol, sorbitol, propylene glycol (MPG), ethylene glycol, diethylene glycol, triethylene glycol, 1,2-propylene glycol or 1,3-propylene glycol, dipropylene glycol, polyethylene glycol (PEG) having an average molecular weight below about 600 and polypropylene glycol (PPG) having an average molecular weight below about 600. In one embodiment, the liquid formulation comprises 20%-80% polyol (i.e., total amount of polyol), e.g., 25%-75% polyol, 30%-70% polyol, 35%-65% polyol, or 40%-60% polyol, wherein the polyol is selected from the group consisting of glycerol, sorbitol and propylene glycol (MPG).

In another embodiment, the preservative is selected from the group consisting of sodium sorbate, potassium sorbate, sodium benzoate and potassium benzoate or any combination thereof. In one embodiment, the liquid formulation comprises 0.02% to 1.5% w/w preservative, e.g., 0.05% to 1.0% w/w preservative or 0.1% to 0.5% w/w preservative. In one embodiment, the liquid formulation comprises 0.001% to 2.0% w/w preservative (i.e., total amount of preservative), e.g., 0.02% to 1.5% w/w preservative, 0.05% to 1.0% w/w preservative, or 0.1% to 0.5% w/w preservative, wherein the preservative is selected from the group consisting of sodium sorbate, potassium sorbate, sodium benzoate and potassium benzoate or any combination thereof.

In another embodiment, the liquid formulation further comprises one or more additional enzymes, e.g., hydrolase, isomerase, ligase, lyase, oxidoreductase, and transferase. The one or more additional enzymes are preferably selected from the group consisting of acetylxylan esterase, acylglycerol lipase, amylase, alpha-amylase, beta-amylase, arabinofuranosidase, cellobiohydrolases, cellulase, feruloyl esterase, galactanase, alpha-galactosidase, beta-galactosidase, beta-glucanase, beta-glucosidase, lysophospholipase, lysozyme, alpha-mannosidase, beta-mannosidase (mannanase), phytase, phospholipase A1, phospholipase A2, phospholipase D, protease, pullulanase, pectin esterase, triacylglycerol lipase, xylanase, beta-xylosidase or any combination thereof.

Fermentation Broth Formulations or Cell Compositions

The present invention also relates to a fermentation broth formulation or a cell composition comprising a polypeptide of the present invention. The fermentation broth formulation or cell composition comprises a polypeptide having pectinase activity (e.g., a polygalacturonase from the GH28 family, a rhamnogalacturonase, from the GH28 family, a pectin methyl esterase from the CE8 family, a pectin lyase from the PL1 family, a pectin acetyl esterase from the CE12 family or CE16 family, a rhamnogalacturonan lyase from the PL4 family, a beta-galactanase from the GH53 family, and combinations thereof).

The fermentation broth formulation or the cell composition further comprises additional ingredients used in the fermentation process, such as, for example, cells (including, the host cells containing the gene encoding the polypeptide of the present invention which are used to produce the polypeptide of interest), cell debris, biomass, fermentation media and/or fermentation products. In some embodiments, the composition is a cell-killed whole broth containing organic acid(s), killed cells and/or cell debris, and culture medium.

The term "fermentation broth" as used herein refers to a preparation produced by cellular fermentation that undergoes no or minimal recovery and/or purification. For example, fermentation broths are produced when microbial cultures are grown to saturation, incubated under carbon-limiting conditions to allow protein synthesis (e.g., expression of enzymes by host cells) and secretion into cell culture medium. The fermentation broth can contain unfractionated or fractionated contents of the fermentation materials derived at the end of the fermentation. Typically, the fermentation broth is unfractionated and comprises the spent culture medium and cell debris present after the microbial cells (e.g., filamentous fungal cells) are removed, e.g., by centrifugation. In some embodiments, the fermentation broth contains spent cell culture medium, extracellular enzymes, and viable and/or nonviable microbial cells.

In some embodiments, the fermentation broth formulation or the cell composition comprises a first organic acid component comprising at least one 1-5 carbon organic acid and/or a salt thereof and a second organic acid component comprising at least one 6 or more carbon organic acid and/or a salt thereof. In some embodiments, the first organic acid component is acetic acid, formic acid, propionic acid, a salt thereof, or a mixture of two or more of the foregoing and the second organic acid component is benzoic acid, cyclohexanecarboxylic acid, 4-methylvaleric acid, phenylacetic acid, a salt thereof, or a mixture of two or more of the foregoing.

In one aspect, the composition contains an organic acid(s), and optionally further contains killed cells and/or cell debris. In some embodiments, the killed cells and/or cell debris are removed from a cell-killed whole broth to provide a composition that is free of these components.

The fermentation broth formulation or cell composition may further comprise a preservative and/or anti-microbial (e.g., bacteriostatic) agent, including, but not limited to, sorbitol, sodium chloride, potassium sorbate, and others known in the art.

The cell-killed whole broth or composition may contain the unfractionated contents of the fermentation materials derived at the end of the fermentation. Typically, the cell-killed whole broth or composition contains the spent culture medium and cell debris present after the microbial cells (e.g., filamentous fungal cells) are grown to saturation, incubated under carbon-limiting conditions to allow protein synthesis. In some embodiments, the cell-killed whole broth or composition contains the spent cell culture medium, extracellular enzymes, and killed filamentous fungal cells. In some embodiments, the microbial cells present in the cell-killed whole broth or composition can be permeabilized and/or lysed using methods known in the art.

A whole broth or cell composition as described herein is typically a liquid, but may contain insoluble components, such as killed cells, cell debris, culture media components, and/or insoluble enzyme(s). In some embodiments, insoluble components may be removed to provide a clarified liquid composition.

The whole broth formulations and cell composition of the present invention may be produced by a method described in WO 90/15861 or WO 2010/096673.

Uses

The polypeptides having pectinase activity (e.g., polygalacturonase activity, rhamnogalacturonase activity, pectin methyl esterase, pectin lyase activity, pectin acetyl esterase activity, rhamnogalacturonan lyase activity, beta-galactanase activity, etc.) may be used in applications where fiber, for example in cereal grains, such as corn, wheat, rice, oats, and barley, needs to be degraded (e.g., under acidic conditions). Accordingly, aspects of the present invention relate to use of the polypeptides having pectinase activity (e.g., a polygalacturonase from the GH28 family, a rhamnogalacturonase, from the GH28 family, a pectin methyl esterase from the CE8 family, a pectin lyase from the PL1 family, a pectin acetyl esterase from the CE12 family or CE16 family, a rhamnogalacturonan lyase from the PL4 family, a beta-galactanase from the GH53 family, and combinations thereof) for degrading a fiber and processes of degrading a fiber comprising contacting the fiber with at least one polypeptide having pectinase activity (e.g., polygalacturonase activity, rhamnogalacturonase activity, pectin methyl esterase, pectin lyase activity, pectin acetyl esterase activity, rhamnogalacturonan lyase activity, beta-galactanase activity, etc.).

Preferably, the fiber degraded in a use or process of the present invention is a cereal fiber, such as corn, wheat, rice, oats, and barley, wherein the process is carried out under acidic conditions having pH of 7.5 or less using polypeptides having pectinase activity ((e.g., polygalacturonase activity, rhamnogalacturonase activity, pectin methyl esterase, pectin lyase activity, pectin acetyl esterase activity, rhamnogalacturonan lyase activity, beta-galactanase activity, etc.) that are stable and active under those conditions.

In one aspect, the process of degrading a fiber is a process for producing a fermentation product from starch-containing material, wherein a partially degraded starch-containing material containing fiber is contacted with at least one polypeptide having pectinase activity during saccharification, fermentation, or simultaneous saccharification and fermentation using a fermenting organism to produce the fermentation product.

In another aspect, at least one polypeptide having pectinase activity is used for degrading a fiber during a process for producing a fermentation product from starch-containing material by contacting a partially degraded starch-containing material containing a fiber with at least one polypeptide having pectinase activity during saccharification, fermentation, or simultaneous saccharification and fermentation using a fermenting organism to produce the fermentation product.

The starch-containing material may be partially degraded prior to saccharification, fermentation, or simultaneous saccharification and fermentation via liquefaction at high temperatures (e.g., above the gelatinization temperature of the starch-containing material) using one or more thermostable enzymes, such as thermostable alpha-amylases, proteases, phytases, endoglucanases, pullulanases, glucoamylases, and/or xylanases. For example, the liquefaction may be carried out when corn is the starch-containing material at a temperature range of 70-100 degrees Celsius inclusive. The starch-containing material may be partially degraded during saccharification, fermentation, or simultaneous saccharification at temperatures below the gelatinization using glucoamylase and alpha-amylase in a raw-starch hydrolysis process, in which the at least one polypeptide having pectinase activity is contacted with the starch-containing material as it is being partially degraded.

In one aspect, the process of degrading a fiber is a process for producing a fermentation product from cellulosic-containing material, wherein a partially degraded cellulosic-containing material containing fiber is contacted with at least one polypeptide having pectinase activity during saccharification, fermentation, or simultaneous saccharification and fermentation using a fermenting organism to produce the fermentation product.

In another aspect, at least one polypeptide having pectinase activity is used for degrading a fiber during a process for producing a fermentation product from cellulosic-containing material by contacting a partially degraded cellulosic-containing material containing a fiber with at least one polypeptide having pectinase activity during saccharification, fermentation, or simultaneous saccharification and fermentation using a fermenting organism to produce the fermentation product.

The cellulosic-containing material may be partially degraded prior to saccharification, fermentation, or simultaneous saccharification and fermentation via an optimal pretreatment step described herein.

In an embodiment, the at least one polypeptide having pectinase activity has a pH optimum of less than 8.0, less than 7.5, less than 7.0, less than 6.5, less than 6.0, less than 5.5, less than or equal to about 5.0, less than or equal to about 4.9, less than or equal to about 4.9, less than or equal to about 4.8, less than or equal to about 4.8, less than or equal to about 4.7, less than or equal to about 4.6, or less than or equal to about 4.5. In an embodiment, the at least one polypeptide having pectinase activity (e.g., a polygalacturonase from the GH28 family, a rhamnogalacturonase, from the GH28 family, a pectin methyl esterase from the CE8 family, a pectin lyase from the PL1 family, a pectin acetyl esterase from the CE12 family or CE16 family, a rhamnogalacturonan lyase from the PL4 family, a beta-galactanase from the GH53 family, and combinations thereof) having a pH optimum of less than 8.0, less than 7.5, less than 7.0, less than 6.5, less than 6.0, less than 5.5, less than or equal to about 5.0, less than or equal to about 4.9, less than or equal to about 4.9, less than or equal to about 4.8, less than or equal to about 4.8, less than or equal to about 4.7, less than or equal to about 4.6, or less than or equal to about 4.5, is used to degrade fiber, for example, by contacting a fiber during the saccharification, fermentation, or simultaneous saccharification and fermentation step of a process for producing a fermentation product from a starch-containing or cellulosic-containing material (e.g., the production of alcohol, such as fuel ethanol, from corn or pre-treated corn stover).

In an embodiment, at least one polypeptide having pectinase activity has an isoelectric point (Pi) of less than 8.0, less than 7.5, less than 7.0, less than 6.5, less than 6.0, less than 5.5, less than or equal to about 5.0, less than or equal to about 4.9, less than or equal to about 4.9, less than or equal to about 4.8, less than or equal to about 4.8, less than or equal to about 4.7, less than or equal to about 4.6, or less than or equal to about 4.5. In an embodiment, at least one polypeptide having pectinase activity (e.g., a polygalacturonase from the GH28 family, a rhamnogalacturonase, from the GH28 family, a pectin methyl esterase from the CE8 family, a pectin lyase from the PL1 family, a pectin acetyl esterase from the CE12 family or CE16 family, a rhamnogalacturonan lyase from the PL4 family, a beta-galactanase from the GH53 family, and combinations thereof) having an isoelectric point (Pi) of less than 8.0, less than 7.5, less than 7.0, less than 6.5, less than 6.0, less than 5.5, less than or equal to about 5.0, less than or equal to about 4.9, less than or equal to about 4.9, less than or equal to about 4.8, less than or equal to about 4.8, less than or equal to about 4.7, less than or equal to about 4.6, or less than or equal to about 4.5, is used to degrade fiber, for example, by contacting a fiber during the saccharification, fermentation, or simultaneous saccharification and fermentation step of a process for producing a fermentation product from a starch-containing material (e.g., the production of alcohol, such as fuel ethanol, from corn) or a cellulosic-containing material (e.g., the production of alcohol, such as fuel ethanol, from pre-treated corn stover).

Such polypeptides having pectinase activity (e.g., a polygalacturonase from the GH28 family, a rhamnogalacturonase, from the GH28 family, a pectin methyl esterase from the CE8 family, a pectin lyase from the PL1 family, a pectin acetyl esterase from the CE12 family or CE16 family, a rhamnogalacturonan lyase from the PL4 family, a beta-galactanase from the GH53 family, and combinations thereof) for degrading fiber, for example in a process of the invention, preferably are selected from the group consisting of: (a) polypeptides having at least 60%, at least 65%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99%, or 100% sequence identity to SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO; 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 95, SEQ ID NO: 98, SEQ ID NO: 101, SEQ ID NO: 104, SEQ ID NO: 107, SEQ ID NO: 134, SEQ ID NO: 137, SEQ ID NO: 140, SEQ ID NO: 143, or SEQ ID NO: 146, which have pectinase activity; (b) polypeptides having at least 60%, at least 65%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99%, or 100% sequence identity to the sequence of SEQ ID NO: 3, SEQ ID NO: 6, SEQ ID NO: 9, SEQ ID NO: 12, SEQ ID NO: 15, SEQ ID NO: 18, SEQ ID NO: 21, SEQ ID NO: 24, SEQ ID NO: 27, SEQ ID NO: 30, SEQ ID NO: 33, SEQ ID NO: 36, SEQ ID NO: 39, SEQ ID NO: 42, SEQ ID NO: 45, SEQ ID NO: 48, SEQ ID NO: 51, SEQ ID NO: 54, SEQ ID NO: 57, SEQ ID NO; 60, SEQ ID NO: 63, SEQ ID NO: 66, SEQ ID NO: 69, SEQ ID NO: 72, SEQ ID NO: 75, SEQ ID NO: 78, SEQ ID NO: 81, SEQ ID NO: 84, SEQ ID NO: 87, SEQ ID NO: 90, SEQ ID NO: 93, SEQ ID NO: 96, SEQ ID NO: 99, SEQ ID NO: 102, SEQ ID NO: 105, SEQ ID NO: 108, SEQ ID NO: 135, SEQ ID NO: 138, SEQ ID NO: 141, SEQ ID NO: 144, or SEQ ID NO: 147, which have pectinase activity; (c) polypeptides having at least 60%, at least 65%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99%, or 100% sequence identity to a mature polypeptide of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO; 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 95, SEQ ID NO: 98, SEQ ID NO: 101, SEQ ID NO: 104, SEQ ID NO: 107, SEQ ID NO: 134, SEQ ID NO: 137, SEQ ID NO: 140, SEQ ID NO: 143, or SEQ ID NO: 146, which have pectinase activity; (d) polypeptides encoded by a polynucleotide that hybridizes under medium, medium-high, high, or very high stringency conditions with the full-length complement of the mature polypeptide coding sequence of SEQ ID NO: 1, SEQ ID NO: 4, SEQ ID NO: 7, SEQ ID NO: 10, SEQ ID NO: 13, SEQ ID NO: 16, SEQ ID NO: 19, SEQ ID NO: 22, SEQ ID NO: 25, SEQ ID NO: 28, SEQ ID NO: 31, SEQ ID NO: 34, SEQ ID NO: 37, SEQ ID NO: 40, SEQ ID NO: 43, SEQ ID NO: 46, SEQ ID NO: 49, SEQ ID NO: 52, SEQ ID NO: 55, SEQ ID NO: 58, SEQ ID NO: 61, SEQ ID NO: 64, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 91, SEQ ID NO: 94, SEQ ID NO: 97, SEQ ID NO: 100, SEQ ID NO: 103, SEQ ID NO: 106, SEQ ID NO: 133, SEQ ID NO: 136, SEQ ID NO: 139, SEQ ID NO: 142, or SEQ ID NO: 145 or the cDNA sequences thereof, which have pectinase activity; (e) polypeptides encoded by a polynucleotide having at least 60%, at least 65%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99%, or 100% sequence identity to the mature polypeptide coding sequence of SEQ ID NO: 1, SEQ ID NO: 4, SEQ ID NO: 7, SEQ ID NO: 10, SEQ ID NO: 13, SEQ ID NO: 16, SEQ ID NO: 19, SEQ ID NO: 22, SEQ ID NO: 25, SEQ ID NO: 28, SEQ ID NO: 31, SEQ ID NO: 34, SEQ ID NO: 37, SEQ ID NO: 40, SEQ ID NO: 43, SEQ ID NO: 46, SEQ ID NO: 49, SEQ ID NO: 52, SEQ ID NO: 55, SEQ ID NO: 58, SEQ ID NO: 61, SEQ ID NO: 64, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 91, SEQ ID NO: 94, SEQ ID NO: 97, SEQ ID NO: 100, or SEQ ID NO: 103, SEQ ID NO: 106, SEQ ID NO: 133, SEQ ID NO: 136, SEQ ID NO: 139, SEQ ID NO: 142, or SEQ ID NO: 145, or the cDNA sequences thereof, which have pectinase activity; and (f) fragments of (a), (b), (c), (d), and/or (e) that have pectinase activity. The uses and processes of the present invention contemplate using at least one polypeptide as described herein as a mono-component, in a composition of the present invention comprising the at least one polypeptide and/or at least one additional enzyme and/or at least one recombinant host cell (e.g., a recombinant yeast host cell comprising at least one heterologous polynucleotide), use of the at least one polypeptide as described herein in recombinant host cells (e.g., recombinant yeast host cells) comprising at least one heterologous polynucleotide expressing the at least one polypeptide. The recombinant yeast host cell can be used during fermentation or SSF for in situ expression of the at least one polypeptide to replace (i.e., eliminate) or reduce exogenous addition of the at least one polypeptide during a process for producing a fermentation product (e.g., fuel ethanol).

Processes for Producing Fermentation Products from Un-Gelatinized Starch-Containing Material.

The invention relates to processes for producing fermentation products from starch-containing material without gelatinization (i.e., without cooking) of the starch-containing material (often referred to as a "raw starch hydrolysis" process). The fermentation product, such as ethanol, can be produced without liquefying the aqueous slurry containing the starch-containing material and water. In one embodiment a process of the invention includes saccharifying (e.g., milled) starch-containing material, e.g., granular starch, below the initial gelatinization temperature, preferably in the presence of an alpha-amylase and carbohydrate-source generating enzyme(s) to produce sugars that can be fermented into the fermentation product by a suitable fermenting organism. In this embodiment the desired fermentation product, e.g., ethanol, is produced from un-gelatinized (i.e., uncooked), preferably milled, cereal grains, such as corn.

Processes for producing a fermentation product from starch-containing material may comprise simultaneously saccharifying and fermenting starch-containing material using a carbohydrate-source generating enzymes and a fermenting organism at a temperature below the initial gelatinization temperature of said starch-containing material in the presence of an polypeptide having pectinase activity (e.g., a polygalacturonase from the GH28 family, a rhamnogalacturonase, from the GH28 family, a pectin methyl esterase from the CE8 family, a pectin lyase from the PL1 family, a pectin acetyl esterase from the CE12 family or CE16 family, a rhamnogalacturonan lyase from the PL4 family, a beta-galactanase from the GH53 family, and combinations thereof) of the invention. Saccharification and fermentation may also be separate.

In the first aspect the invention relates to processes for producing fermentation products, preferably ethanol, from starch-containing material comprising the steps of:

i) saccharifying the starch-containing material using a carbohydrate-source generating enzyme at a temperature below the initial gelatinization temperature; and
ii) fermenting using a fermenting organism;

wherein at least one polypeptide having pectinase activity present or added during saccharifying step i) or fermenting step ii), and wherein the at least one polypeptide having pectinase activity is selected from the group consisting of a polygalacturonase from the GH28 family, a rhamnogalacturonase from the GH28 family, a pectin methyl esterase from the CE8 family, a pectin lyase from the PL1 family, a pectin acetyl esterase from the CE12 family or CE16 family, a rhamnogalacturonan lyase from the PL4 family, a beta-galactanase from the GH53 family, and combinations thereof. In some embodiments, at least two, at least three, at least four, or at least five polypeptides having pectinase activity selected from the group consisting of a polygalacturonase from the GH28 family, a rhamnogalacturonase from the GH28 family, a pectin methyl esterase from the CE8 family, a pectin lyase from the PL1 family, a pectin acetyl esterase from the CE12 family or CE16 family, a rhamnogalacturonan lyase from the PL4 family, a beta-galactanase from the GH53 family, and combinations thereof, are present and/or added during saccharification, fermentation or simultaneous saccharification and fermentation.

The at least one polypeptide having pectinase activity present or added in the above described processes for producing fermentation products from un-gelatinized starch-containing material may be added exogenously during saccharification, fermentation or simultaneous saccharification and fermentation as mono-components, as enzyme blends or compositions comprising the pectinases, and/or via in-situ expression and secretion of the pectinases by the fermenting organism, e.g., a recombinant host cell or fermenting organism described herein (e.g., yeast, such as from the genus *Saccharomyces*, preferably *Saccharomyces cerevisiae*).

Processes for Producing Fermentation Products from Gelatinized Starch-Containing Material In this aspect, the invention relates to processes for producing fermentation products, especially ethanol, from starch-containing material, which process includes a liquefaction step and sequentially or simultaneously performed saccharification and fermentation steps.

Consequently, the invention relates to processes for producing fermentation products from starch-containing material comprising the steps of:

i) liquefying the starch-containing material at a temperature above the initial gelatinization temperature using an alpha-amylase;
ii) saccharifying using a carbohydrate-source generating enzyme; and
iii) fermenting using a fermenting organism;

wherein at least one polypeptide having pectinase activity present or added during saccharifying step i) or fermenting step ii), and wherein the at least one polypeptide having pectinase activity is selected from the group consisting of a polygalacturonase from the GH28 family, a rhamnogalacturonase from the GH28 family, a pectin methyl esterase from the CE8 family, a pectin lyase from the PL1 family, a pectin acetyl esterase from the CE12 family or CE16 family, a rhamnogalacturonan lyase from the PL4 family, a beta-galactanase from the GH53 family, and combinations thereof. In some embodiments, at least two, at least three, at least four, or at least five polypeptides having pectinase activity selected from the group consisting of a polygalacturonase from the GH28 family, a rhamnogalacturonase from the GH28 family, a pectin methyl esterase from the CE8 family, a pectin lyase from the PL1 family, a pectin acetyl esterase from the CE12 family or CE16 family, a rhamnogalacturonan lyase from the PL4 family, a beta-galactanase from the GH53 family, and combinations thereof, are present and/or added during saccharification, fermentation or simultaneous saccharification and fermentation.

The at least one polypeptide having pectinase activity present or added in the above described processes for producing fermentation products from gelatinized starch-containing material may be added exogenously during saccharification, fermentation or simultaneous saccharification and fermentation as mono-components, as enzyme blends or compositions comprising the pectinases, and/or via in-situ expression and secretion of the pectinases by the fermenting organism, e.g., a recombinant host cell or fermenting organism described herein (e.g., yeast, such as from the genus *Saccharomyces*, preferably *Saccharomyces cerevisiae*).

Processes for Producing Fermentation Products from Cellulosic-Containing Material In this aspect, the invention relates to processes for producing fermentation products, especially ethanol, from cellulosic-containing material, which process may include a pretreatment step and sequentially or simultaneously performed saccharification and fermentation steps.

Consequently, the invention relates to processes for producing fermentation products from cellulosic-containing material comprising the steps of:

i) optionally pretreating a cellulosic-containing material;
ii) saccharifying a cellulosic-containing material and/or pretreated cellulosic-containing material using a carbohydrate-source generating enzyme; and
iii) fermenting using a fermenting organism;

wherein at least one polypeptide having pectinase activity present or added during saccharifying step i) or fermenting step ii), and wherein the at least one polypeptide having pectinase activity is selected from the group consisting of a polygalacturonase from the GH28 family, a rhamnogalacturonase from the GH28 family, a pectin methyl esterase from the CE8 family, a pectin lyase from the PL1 family, a pectin acetyl esterase from the CE12 family or CE16 family, a rhamnogalacturonan lyase from the PL4 family, a beta-galactanase from the GH53 family, and combinations thereof. In some embodiments, at least two, at least three, at least four, or at least five polypeptides having pectinase activity selected from the group consisting of a polygalacturonase from the GH28 family, a rhamnogalacturonase from the GH28 family, a pectin methyl esterase from the CE8 family, a pectin lyase from the PL1 family, a pectin acetyl esterase from the CE12 family or CE16 family, a rhamnogalacturonan lyase from the PL4 family, a beta-galactanase from the GH53 family, and combinations thereof, are present and/or added during saccharification, fermentation or simultaneous saccharification and fermentation. The at least one polypeptide having pectinase activity present or added in the above described processes for producing fermentation products from cellulosic-containing material may be added exogenously during saccharification, fermentation or simultaneous saccharification and fermentation as mono-components, as enzyme blends or compositions comprising the pectinases, and/or via in-situ expression and secretion of the pectinases by the fermenting organism, e.g., a recombinant host cell or fermenting organism described herein (e.g., yeast, such as from the genus *Saccharomyces*, preferably *Saccharomyces cerevisiae*).

Steps ii) and iii) are carried out either sequentially or simultaneously. In a preferred embodiment steps ii) and iii) are carried out simultaneously. The alpha-amylase, an optional thermostable protease or an optional thermostable xylanase, may be added before and/or during liquefaction step i).

A composition of the invention may suitably be used in a process of the invention. A recombinant host cell or fermenting organism of the invention may suitably be used in a process of the invention. However, the enzymes may also be added separately. In one embodiment, a composition of the invention comprises at least one polypeptide having pectinase of the present invention and a recombinant yeast host cell comprising at least one heterologous polynucleotide.

Whether the process of the invention includes or does not include a liquefaction step or pretreatment step, the essential feature of the invention is that at least one polypeptide having pectinase activity (e.g., a polygalacturonase from the GH28 family, a rhamnogalacturonase from the GH28 family, a pectin methyl esterase from the CE8 family, a pectin lyase from the PL1 family, a pectin acetyl esterase from the CE12 family or CE16 family, a rhamnogalacturonan lyase from the PL4 family, a beta-galactanase from the GH53 family, and combinations thereof) is present or added during fermentation or simultaneous saccharification and fermentation.

In one embodiment, at least one polypeptide having polygalacturonase activity from the GH28 family is present or added during fermentation or simultaneous saccharification and fermentation. In another embodiment, at least one polypeptide having rhamnogalacturonase activity from the GH28 family is present or added during fermentation or simultaneous saccharification and fermentation. In another embodiment, at least one polypeptide having pectin methyl esterase activity from the CE8 family is present or added during fermentation or simultaneous saccharification and fermentation. In another embodiment, at least one polypeptide having pectin lyase activity from the PL1 family is present or added during fermentation or simultaneous saccharification and fermentation. In another embodiment, at least one polypeptide having pectin acetyl esterase activity from the CE12 family or CE16 family is present or added during fermentation or simultaneous saccharification and fermentation. In another embodiment, at least one polypeptide having rhamnogalacturonan lyase activity from the PL4 family is present or added during fermentation or simultaneous saccharification and fermentation. In another embodiment, at least one polypeptide having beta-galactanase from the GH53 family is present or added during fermentation or simultaneous saccharification and fermentation.

As noted above, the at least one polypeptide may be added exogenously as a standalone enzyme or an enzyme blend or composition comprising at least one, at least two, at least three, at least four, or at least five polypeptides having pectinase activity, or expressed and secreted in situ by a recombinant host cell or fermenting organism of the present invention comprising at least one, at least two, at least three, at least four, or at least five polypeptides having pectinase activity.

The present inventors have found that pectinases belonging to various GH families, CE families, or PL families are most suitable for application in the present invention. In one embodiment the polypeptide having pectinase activity is a member of a glycoside hydrolase (GH) family selected from the group consisting of GH28 and GH53. In another embodiment the polypeptide having pectinase activity is a member of a carbohydrate esterase (CE) family selected from the group consisting of CE8, CE12 and CE16. In another embodiment, the polypeptide having pectinase activity is a member of the PL1 family, preferably subfamilies PL1_1, PL1_3, and PL1_4.

Any polygalacturonase from the GH28 family can be present and/or added during saccharification, fermentation, or SSF in a process of the invention. In an embodiment, the polypeptide having pectinase activity from the GH28 family is a polygalacturonase I from the GH28 family. In an embodiment, the polypeptide having pectinase activity from the GH28 family is a polygalacturonase II from the GH28 family. In an embodiment, the polypeptide having pectinase activity from the GH28 family is a polygalacturonase Ill from the GH28 family. In an embodiment, the polypeptide having pectinase activity from the GH28 family is a polygalacturonase IV from the GH28 family.

As noted herein, the polygalacturonase from the GH28 family can be obtained or derived from any microbial sources (e.g., fungal). In an embodiment, the polygalacturonase from the GH28 family is from a strain of *Aspergillus* or is a non-naturally occurring variant of an *Aspergillus* polygalacturonase, for example, from a strain of *Aspergillus aculeatus, Aspergillus luchuensis*, or *Aspergillus niger*. In an embodiment, the polygalacturonase from the GH28 family is from a strain of *Thermoascus* or is a non-naturally occurring variant of a *Thermoascus* polygalacturonase, for example *Thermoascus crustaceus*. In an embodiment, the polygalacturonase from the GH28 family is from a strain of *Penicillium* or is a non-naturally occurring variant of a *Penicillium* polygalacturonase, for example *Penicillium oxalicum*.

In an embodiment, the polygalacturonase from the GH28 family is selected from the group consisting of:

(i) the mature polypeptide of SEQ ID NO: 2, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to SEQ ID NO: 2 or SEQ ID NO: 3;

(ii) the mature polypeptide of SEQ ID NO: 5, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity or at least 99% identity to SEQ ID NO: 5 or SEQ ID NO: 6;

(iii) the mature polypeptide of SEQ ID NO: 8, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity or at least 99% identity to SEQ ID NO: 8 or SEQ ID NO: 9;

(iv) the mature polypeptide of SEQ ID NO: 11, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity or at least 99% identity to SEQ ID NO: 11 or SEQ ID NO: 12;

(v) the mature polypeptide of SEQ ID NO: 14, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 14 or SEQ ID NO: 15;

(vi) the mature polypeptide of SEQ ID NO: 17, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 17 or SEQ ID NO: 18;

(vii) the mature polypeptide of SEQ ID NO: 20, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 20 or SEQ ID NO: 21;

(viii) the mature polypeptide of SEQ ID NO: 23, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 23 or SEQ ID NO: 24;

(ix) the mature polypeptide of SEQ ID NO: 26, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 26 or SEQ ID NO: 27;

(x) the mature polypeptide of SEQ ID NO: 29, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 29 or SEQ ID NO: 30;

(xi) the mature polypeptide of SEQ ID NO: 32, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 32 or SEQ ID NO: 33;

(xii) the mature polypeptide of SEQ ID NO: 35, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 35 or SEQ ID NO: 36;

(xiii) the mature polypeptide of SEQ ID NO: 38, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 38 or SEQ ID NO: 39;

(xiv) the mature polypeptide of SEQ ID NO: 41, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 41 or SEQ ID NO: 42;

(xv) the mature polypeptide of SEQ ID NO: 44, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 44 or SEQ ID NO: 45; and (xvi) the mature polypeptide of SEQ ID NO: 143, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 143 or SEQ ID NO: 144.

In an embodiment, the at least one polypeptide having pectinase activity is a rhamnogalacturonase from the GH28 family. Any rhamnogalacturonase from the GH28 family can be present and/or added during saccharification, fermentation, or SSF in a process of the invention. In an embodiment, the rhamnogalacturonase from the GH28 family is a rhamnogalacturonase I, or a rhamnogalacturonase II, from the GH28 family.

The rhamnogalacturonase from the GH28 family can be obtained or derived from any microbial source (e.g., fungal). In an embodiment, the GH28 family rhamnogalacturonase is from a strain of *Aspergillus* or is a non-naturally occurring variant of an *Aspergillus* rhamnogalacturonase, preferably *Aspergillus aculeatus, Aspergillus luchuensis, Aspergillus niger*, or *Aspergillus oryzae*. In an embodiment, the GH28 family rhamnogalacturonase is from a strain of *Penicillium* or is a non-naturally occurring variant of a *Penicillium* rhamnogalacturonase, preferably *Penicillium* sp. XZ2495 or *Penicillium* sp. 54788. In an embodiment, the GH28 family rhamnogalacturonase is from a strain of *Talaromyces* or is a non-naturally occurring variant of a *Talaromyces* rhamnogalacturonase, preferably *Talaromyces leycettanus, Talaromyces calidicanius*, or *Talaromyces* sp. XZ2925.

In an embodiment, the GH28 family rhamnogalacturonase is selected from the group consisting of:

(i) the mature polypeptide of SEQ ID NO: 47, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to SEQ ID NO: 47 or SEQ ID NO: 48;

(ii) the mature polypeptide of SEQ ID NO: 50, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity or at least 99% identity to SEQ ID NO: 50 or SEQ ID NO: 51;

(iii) the mature polypeptide of SEQ ID NO: 53, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity or at least 99% identity to SEQ ID NO: 53 or SEQ ID NO: 54;

(iv) the mature polypeptide of SEQ ID NO: 56, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity or at least 99% identity to SEQ ID NO: 56 or SEQ ID NO: 57;

(v) the mature polypeptide of SEQ ID NO: 59, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 59 or SEQ ID NO: 60;

(vi) the mature polypeptide of SEQ ID NO: 62, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 62 or SEQ ID NO: 63;

(vii) the mature polypeptide of SEQ ID NO: 134, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 134 or SEQ ID NO: 135; and (viii) the mature polypeptide of SEQ ID NO: 146, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 146 or SEQ ID NO: 147.

In an embodiment, the polypeptide having pectinase activity is a pectin methyl esterase from the CE8 family. Any pectin methyl esterase from the CE8 family can be present and/or added during saccharification, fermentation, or SSF in a process of the invention.

The pectin methyl esterase from the CE8 family can be obtained or derived from any microbial source (e.g., fungal). In an embodiment, the pectin methyl esterase from the CE8 family is from a strain of *Aspergillus* or is a non-naturally occurring variant of an *Aspergillus* pectin methyl esterase, preferably *Aspergillus aculeatus, Aspergillus luchuensis*, or *Aspergillus niger.*

In an embodiment, the pectin methyl esterase from the CE8 family is selected from the group consisting of:

(i) the mature polypeptide of SEQ ID NO: 65, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to SEQ ID NO: 65 or SEQ ID NO: 66;

(ii) the mature polypeptide of SEQ ID NO: 68, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity or at least 99% identity to SEQ ID NO: 68 or SEQ ID NO: 69;

(iii) the mature polypeptide of SEQ ID NO: 71, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity or at least 99% identity to SEQ ID NO: 71 or SEQ ID NO: 72; and (iv) the mature polypeptide of SEQ ID NO: 74, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity or at least 99% identity to SEQ ID NO: 74 or SEQ ID NO: 75.

In an embodiment, the polypeptide having pectinase activity is a pectin lyase from the Polysaccharide Lyase (PL) 1 family, preferably PL1 subfamily 4. Any pectin lyase from the PL1 family, preferably PL1 subfamily 4, can be present and/or added during saccharification, fermentation, or SSF in a process of the invention.

The PL1 family pectin lyase, preferably PL1 subfamily 4, can be obtained or derived from any microbial source (e.g., fungal). In an embodiment, the pectin lyase from the PL1 family, preferably PL1 subfamily 4, is from a strain of *Aspergillus* or is a non-naturally occurring variant of an *Aspergillus* pectin lyase, preferably *Aspergillus luchuensis* or *Aspergillus niger*. In an embodiment, the pectin lyase from the PL1 family, preferably PL1 subfamily 4, is from a strain of *Thielavia* or a non-naturally occurring variant of a *Thielavia* pectin lyase, preferably *Thielavia hyrcaniae*.

In an embodiment, the pectin lyase from the PL1 family, preferably PL1 subfamily 4, is selected from the group consisting of:

(i) the mature polypeptide of SEQ ID NO: 77, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to SEQ ID NO: 77 or SEQ ID NO: 78;

(ii) the mature polypeptide of SEQ ID NO: 80, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity or at least 99% identity to SEQ ID NO: 80 or SEQ ID NO: 81; and.

(iii) the mature polypeptide of SEQ ID NO: 107, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity or at least 99% identity to SEQ ID NO: 107 or SEQ ID NO: 108.

In an embodiment, the polypeptide having pectinase activity is a pectin acetyl esterase from the CE12 family or CE16 family. Any pectin acetyl esterase from the CE12 family or CE16 family can be present and/or added during saccharification, fermentation, or SSF in a process of the invention.

The CE12 family or CE16 family pectin acetyl esterase can be obtained or derived from any microbial source. In an embodiment, the CE12 family or CE16 family pectin acetyl esterase is from a strain of *Aspergillus* or is a non-naturally occurring variant of an *Aspergillus* pectin acetyl esterase, preferably *Aspergillus aculeatus* or *Aspergillus oryzae*. In an embodiment, the CE12 family or CE16 family pectin acetyl esterase is from a strain of *Colletotrichum* or is a non-naturally occurring variant of a *Colletotrichum* pectin acetyl esterase, preferably *Colletotrichum gloeosporioides*.

In an embodiment, the pectin acetyl esterase from the CE12 family or the CE16 family is selected from the group consisting of:

(i) the mature polypeptide of SEQ ID NO: 83, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to SEQ ID NO: 83 or SEQ ID NO: 84;

(ii) the mature polypeptide of SEQ ID NO: 86, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity or at least 99% identity to SEQ ID NO: 86 or SEQ ID NO: 87;

(iii) the mature polypeptide of SEQ ID NO: 89, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity or at least 99% identity to SEQ ID NO: 89 or SEQ ID NO: 90; and (iv) the mature polypeptide of SEQ ID NO: 92, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity or at least 99% identity to SEQ ID NO: 92 or SEQ ID NO: 93.

In an embodiment, the at least one polypeptide having pectinase activity is a rhamnogalacturonan lyase from the PL4 family. Any rhamnogalacturonan lyase from the PL 4 family, preferably PL4 subfamily 1, PL4 subfamily 3, or PL4 subfamily 5, can be present and/or added during saccharification, fermentation, or SSF in a process of the invention.

The PL4 family rhamnogalacturonan lyase can be obtained or derived from any microbial source. In an embodiment, the rhamnogalacturonan lyase from the PL4 family, preferably PL4 subfamily 1, PL4 subfamily 3 or PL4 subfamily 5, is from a strain of *Aspergillus* or is a non-naturally occurring variant of an *Aspergillus* rhamnogalacturonan lyase, preferably *Aspergillus aculeatus* or *Aspergillus oryzae*. In an embodiment, the rhamnogalacturonan lyase from the PL4 family, preferably PL4 subfamily 1, PL4 subfamily 3 or PL4 subfamily 5, is from a strain of *Sporormia* or is a non-naturally occurring variant of a *Sporormia* rhamnogalacturonan lyase, preferably *Sporormia fimetaria*.

In an embodiment, the rhamnogalacturonan lyase from the PL4 family is selected from the group consisting of:

(i) the mature polypeptide of SEQ ID NO: 95, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to SEQ ID NO: 95 or SEQ ID NO: 96;

(ii) the mature polypeptide of SEQ ID NO: 98, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity or at least 99% identity to SEQ ID NO: 98 or SEQ ID NO: 99;

(iii) the mature polypeptide of SEQ ID NO: 101, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity or at least 99% identity to SEQ ID NO: 101 or SEQ ID NO: 102;

(iv) the mature polypeptide of SEQ ID NO: 137, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity or at least 99% identity to SEQ ID NO: 137 or SEQ ID NO: 138; and (v) the mature polypeptide of SEQ ID NO: 140, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity or at least 99% identity to SEQ ID NO: 140 or SEQ ID NO: 141.

In an embodiment, the polypeptide having pectinase activity is a beta-galactanase from the GH53 family. Any beta-galactanase from the GH53 family can be present and/or added during saccharification, fermentation, or SSF in a process of the invention.

The GH53 family beta-galactanase can be obtained or derived from any microbial source. In an embodiment, the beta-galactanase from the GH53 family is from a strain of *Aspergillus* or is a non-naturally occurring variant of an *Aspergillus* beta-galactanase, preferably *Aspergillus aculeatus*.

In an embodiment, the beta-galactanase from the GH53 family comprises, consists of, or consists essentially of the mature polypeptide of SEQ ID NO: 104, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to SEQ ID NO: 104 or SEQ ID NO: 105.

The present disclosure contemplates the use of at least two, at least three, at least four, or at least five, at least six, or at least seven, or more polypeptides having a different type of pectinase activity in a composition or process of the invention (e.g., saccharification, fermentation, or SSF). In an embodiment, the at least one polypeptide having pectinase activity comprises at least two polypeptides having a different type of pectinase activity selected from the group consisting of a polygalacturonase from the GH28 family, a rhamnogalacturonase from the GH28 family, a pectin methyl esterase from the CE8 family, a pectin lyase from the PL1 family, a pectin acetyl esterase from the CE12 family or CE16 family, a rhamnogalacturonan lyase from the PL4 family, and a beta-galactanase from the GH53 family. In an embodiment, the at least one polypeptide having pectinase activity comprises at least three polypeptides having a different type of pectinase activity selected from the group consisting of a polygalacturonase from the GH28 family, a rhamnogalacturonase from the GH28 family, a pectin methyl esterase from the CE8 family, a pectin lyase from the PL1 family, a pectin acetyl esterase from the CE12 family or CE16 family, a rhamnogalacturonan lyase from the PL4 family, and a beta-galactanase from the GH53 family. In an embodiment, the at least one polypeptide having pectinase activity comprises at least four polypeptides having a different type of pectinase activity selected from the group consisting of a polygalacturonase from the GH28 family, a rhamnogalacturonase from the GH28 family, a pectin methyl esterase from the CE8 family, a pectin lyase from the PL1 family, a pectin acetyl esterase from the CE12 family or CE16 family, a rhamnogalacturonan lyase from the PL4 family, and a beta-galactanase from the GH53 family. In an embodiment, the at least one polypeptide having pectinase activity comprises at least five polypeptides having a different type of pectinase activity selected from the group consisting of a polygalacturonase from the GH28 family, a rhamnogalacturonase from the GH28 family, a pectin methyl esterase from the CE8 family, a pectin lyase from the PL1 family, a pectin acetyl esterase from the CE12 family or CE16 family, a rhamnogalacturonan lyase from the PL4 family, and a beta-galactanase from the GH53 family. In an embodiment, the at least one polypeptide having pectinase activity comprises at least six polypeptides having a different type of pectinase activity selected from the group consisting of a polygalacturonase from the GH28 family, a rhamnogalacturonase from the GH28 family, a pectin methyl esterase from the CE8 family, a pectin lyase from the PL1 family, a pectin acetyl esterase from the CE12 family or CE16 family, a rhamnogalacturonan lyase from the PL4 family, and a beta-galactanase from the GH53 family. In an embodiment, the at least one polypeptide having pectinase activity comprises at least seven polypeptides having a different type of pectinase activity selected from the group consisting of a polygalacturonase from the GH28 family, a rhamnogalacturonase from the GH28 family, a pectin methyl esterase from the CE8 family, a pectin lyase from the PL1 family, a pectin acetyl esterase from the CE12 family or CE16 family, a rhamnogalacturonan lyase from the PL4 family, and a beta-galactanase from the GH53 family.

In an embodiment, the at least two polypeptides having a different type of pectinase activity comprise:

(i) a polygalacturonase from the GH28 family; and (ii) a polypeptide having pectinase activity selected from the group consisting of a rhamnogalacturonase from the GH28 family, a pectin methyl esterase from the CE8 family, a pectin lyase from the PL1 family, a pectin acetyl esterase from the CE12 family or CE16 family, a rhamnogalacturonan lyase from the PL4 family, and a beta-galactanase from the GH53 family.

In an embodiment, the at least two polypeptides having a different type of pectinase activity comprise a polygalacturonase from the GH28 family and a pectin methyl esterase from the CE8 family.

In an embodiment, the at least two polypeptides having a different type of pectinase activity comprise a polygalacturonase from the GH28 family and a pectin acetyl esterase from the CE12 family or CE16 family.

In an embodiment, the at least two polypeptides having a different type of pectinase activity comprise a polygalacturonase from the GH28 family and a rhamnogalacturonase from the GH28 family.

In an embodiment, the polygalacturonase from the GH28 family is selected from the group of an endo-polygalacturonase I, an exo-polygalacturonase I, an endo-polygalacturonase II, an exo-polygalacturonase II, an endo-polygalacturonase III, and an exo-polygalacturonase III.

In an embodiment, the at least two polypeptides having a different type of pectinase activity comprise an exo-polygalacturonase II from the GH28 family and a pectin methyl esterase from the CE8 family.

In an embodiment, the at least two polypeptides having pectinase activity comprises a polypeptide having polygalacturonase activity and a polypeptide having pectin methyl esterase activity, wherein the polygalacturonase activity is selected from the group consisting of a polygalacturonase I activity, polygalacturonase II activity, polygalacturonase III activity, and polygalacturonase IV activity.

In an embodiment, the at least two polypeptides having pectinase activity comprises a polypeptide having polygalacturonase activity and a polypeptide having pectin methyl esterase activity, wherein the polypeptide having polygalacturonase activity is from a strain of *Aspergillus*, and wherein the polypeptide having pectin methyl esterase is from a strain of *Aspergillus*.

In an embodiment, the at least two polypeptides having pectinase activity comprises a polypeptide having polygalacturonase activity and a polypeptide having pectin methyl esterase activity, wherein the polypeptide having polygalacturonase activity is from a strain selected from the group consisting of *Aspergillus aculeatus* and *Aspergillus niger*, and wherein the polypeptide having pectin methyl esterase is from a strain selected from the group consisting of *Aspergillus aculeatus* and *Aspergillus niger*.

In an embodiment, the at least two polypeptides having pectinase activity comprise a polypeptide having polygalacturonase activity and a polypeptide having pectin methyl esterase activity, wherein the polypeptide having polygalacturonase activity comprises, consists, or consists essentially of the mature polypeptide of SEQ ID NO: 5, or is a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 5 or the amino acid sequence of SEQ ID NO: 6, which has polygalacturonase activity, and wherein the polypeptide having pectin methyl esterase activity comprises, consists, or consists essentially of the mature polypeptide of SEQ ID NO: 65, or is a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 65 or the amino acid sequence of SEQ ID NO: 66, which has pectin methyl esterase activity.

In an embodiment, the at least two polypeptides having pectinase activity comprise a polypeptide having polygalacturonase activity and a polypeptide having pectin methyl esterase activity, wherein the polypeptide having polygalacturonase activity comprises, consists, or consists essentially of the mature polypeptide of SEQ ID NO: 2, or is a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 2 or the amino acid sequence of SEQ ID NO: 3, which has polygalacturonase activity, and wherein the polypeptide having pectin methyl esterase activity comprises, consists, or consists essentially of the mature polypeptide of SEQ ID NO: 65, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 65 or amino acid sequence of SEQ ID NO: 66, which has pectin methyl esterase activity.

In an embodiment, the at least two polypeptides comprise at least three polypeptides having a different type of pectinase activity, wherein the at least three polypeptides comprise an *Aspergillus* pectin methyl esterase from the CE8 family, for example, from *Aspergillus luchuensis*, an *Aspergillus* endo-polygalacturonase II (PGII) from the GH28 family, for example, from *Aspergillus aculeatus* and an *Aspergillus* pectin lyase A, for example, from *Aspergillus niger*. In an embodiment, the *Aspergillus aculeatus* pectin lyase A is the mature polypeptide of SEQ ID NO: 107, or a polypeptide having at least 70%, at least 75%, at least 80%, at least 85%, at least 90%, at least 95%, at least 96%, at least 97%, at least 98%, or at least 99% sequence identity to the mature polypeptide of SEQ ID NO: 107 or SEQ ID NO: 108.

In an embodiment, the at least three polypeptides having pectinase activity comprise a polypeptide having polygalacturonase activity, a polypeptide having pectin methyl esterase activity, and a polypeptide having pectin lyase activity, wherein the polypeptide having polygalacturonase activity comprises, consists, or consists essentially of the mature polypeptide of SEQ ID NO: 5, or is a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 5 or the amino acid sequence of SEQ ID NO: 6, which has polygalacturonase activity, wherein the polypeptide having pectin methyl esterase activity comprises, consists, or consists essentially of the mature polypeptide of SEQ ID NO: 65, or is a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 65 or the amino acid sequence of SEQ ID NO: 66, which has pectin methyl esterase activity, and wherein the polypeptide having pectin lyase activity comprises, consists, or consists essentially of the mature polypeptide of SEQ ID NO: 107, or is a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 107 or the amino acid sequence of SEQ ID NO: 108, which has pectin lyase activity.

In an embodiment, the at least three polypeptides comprise a polypeptide having polygalacturonase activity, a polypeptide having rhamnogalacturon lyase activity, and a polypeptide having pectin lyase activity. In an embodiment, the at least three polypeptides comprise a polypeptide having polygalacturonase activity from the GH28 family, a polypeptide having rhamnogalacturonan lyase activity from the PL4 family, preferably subfamilies PL4_1, PL4_3, or PL4_5, and a pectin lyase from the PI1 family, preferably subfamily PL1_4. In an embodiment, the at least three polypeptides having pectinase activity comprise a polypeptide having polygalacturonase activity, a polypeptide having rhamnogalacturonan lyase activity, and a polypeptide having pectin lyase activity, wherein the polypeptide having polygalacturonase activity comprises, consists, or consists essentially of the mature polypeptide of SEQ ID NO: 143, or is a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 143 or the amino acid sequence of SEQ ID NO: 144, which has polygalacturonase activity, wherein the polypeptide having rhamnogalacturonan lyase activity comprises, consists, or consists essentially of the mature polypeptide of SEQ ID NO: 140, or is a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 140 or the amino acid sequence of SEQ ID NO: 141, which has rhamnogalacturonanase activity, and wherein the polypeptide having pectin lyase activity comprises, consists, or consists essentially of the mature polypeptide of SEQ ID NO: 77, or is a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 77 or the amino acid sequence of SEQ ID NO: 78, which has pectin lyase activity.

In an embodiment, the at least three polypeptides having pectinase activity comprise a polypeptide having polygalacturonase activity, a polypeptide having pectin methyl esterase activity, and a polypeptide having pectin lyase activity, wherein the polypeptide having polygalacturonase activity comprises, consists, or consists essentially of the mature polypeptide of SEQ ID NO: 2, or is a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 2 or the amino acid sequence of SEQ ID NO: 3, which has polygalacturonase activity, wherein the polypeptide having pectin methyl esterase activity comprises, consists, or consists essentially of the mature polypeptide of SEQ ID NO: 65, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 65 or amino acid sequence of SEQ ID NO: 66, which has pectin methyl esterase activity, and wherein the polypeptide having pectin lyase activity comprises, consists, or consists essentially of the mature polypeptide of SEQ ID NO: 107, or is a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 107 or the amino acid sequence of SEQ ID NO: 108, which has pectin lyase activity.

In an embodiment, the at least two polypeptides having pectinase activity comprises a polypeptide having rhamnogalacturonase activity and a polypeptide having pectin acetyl esterase activity.

In an embodiment, the at least two polypeptides having pectinase activity comprises a polypeptide having rhamnogalacturonase activity and a polypeptide having pectin acetyl esterase activity, wherein the polypeptide having rhamnogalacturonase activity is from the GH28 family, and wherein the polypeptide having pectin acetyl esterase activity is from the CE12 family.

In an embodiment, the at least two polypeptides having pectinase activity comprises a polypeptide having rhamnogalacturonase activity and a polypeptide having pectin acetyl esterase activity, wherein the polypeptide having rhamnogalacturonase activity is from a strain selected from the group consisting of *Aspergillus, Talaromyces* and *Penicillium*, and wherein the polypeptide having pectin acetyl esterase is from a strain of *Aspergillus* and *Colletotrichum.*

In an embodiment, the at least two polypeptides having pectinase activity comprises a polypeptide having rhamnogalacturonase activity and a polypeptide having pectin acetyl esterase activity, wherein the polypeptide having rhamnogalacturonase activity is from a strain selected from the group consisting of *Talaromyces calidicanius, Penicillium* sp. XZ2495 and *Penicillium* sp-54788, and wherein the polypeptide having pectin acetyl esterase is from a strain of *Aspergillus aculeatus* or *Colletotrichum gloeosporioides.*

In an embodiment, the at least two polypeptides having pectinase activity comprises a polypeptide having rhamnogalacturonase activity and a polypeptide having pectin acetyl esterase activity, wherein the polypeptide having rhamnogalacturonase activity comprises, consists, or consists essentially of the mature polypeptide of SEQ ID NO: 53, or is a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 53 or the amino acid sequence of SEQ ID NO: 54, which has rhamnogalacturonase activity, and wherein the polypeptide having pectin acetyl esterase activity comprises, consists, or consists essentially of the mature polypeptide of SEQ ID NO: 83, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 83 or the amino acid sequence of SEQ ID NO: 84, which has pectin acetyl esterase activity.

In an embodiment, the at least two polypeptides having pectinase activity comprises a polypeptide having rhamnogalacturonase activity and a polypeptide having pectin acetyl esterase activity, wherein the polypeptide having rhamnogalacturonase activity comprises, consists, or consists essentially of the mature polypeptide of SEQ ID NO: 53, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 53 or the amino acid sequence of SEQ ID NO: 54, which has rhamnogalacturonase activity, and wherein the polypeptide having pectin acetyl esterase activity comprises, consists, or consists essentially of the mature polypeptide of SEQ ID NO: 86, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 86 or the amino acid sequence of SEQ ID NO: 87, which has pectin acetyl esterase activity.

In an embodiment, the at least two polypeptides having pectinase activity comprises a polypeptide having rhamnogalacturonase activity and a polypeptide having pectin acetyl esterase activity, wherein the polypeptide having rhamnogalacturonase activity comprises, consists, or consists essentially of the mature polypeptide of SEQ ID NO: 56, or is a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 56 or the amino acid sequence of SEQ ID NO: 57, which has rhamnogalacturonase activity, and wherein the polypeptide having pectin acetyl esterase activity comprises, consists, or consists essentially of the mature polypeptide of SEQ ID NO: 83, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 83 or the amino acid sequence of SEQ ID NO: 84, which has pectin acetyl esterase activity.

In an embodiment, the at least two polypeptides having pectinase activity comprises a polypeptide having rhamnogalacturonase activity and a polypeptide having pectin acetyl esterase activity, wherein the polypeptide having rhamnogalacturonase activity comprises, consists, or consists essentially of the mature polypeptide of SEQ ID NO: 56, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 56 or the amino acid sequence of SEQ ID NO: 57, which has rhamnogalacturonase activity, and wherein the polypeptide having pectin acetyl esterase activity comprises, consists, or consists essentially of the mature polypeptide of SEQ ID NO: 86, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 85 or the amino acid sequence of SEQ ID NO: 86, which has pectin acetyl esterase activity.

In an embodiment, the at least two polypeptides having pectinase activity comprises a polypeptide having rhamnogalacturonase activity and a polypeptide having pectin acetyl esterase activity, wherein the polypeptide having rhamnogalacturonase activity comprises, consists, or consists essentially of the mature polypeptide of SEQ ID NO: 59, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 59 or the amino acid sequence of SEQ ID NO: 60, which has rhamnogalacturonase activity, and wherein the polypeptide having pectin acetyl esterase activity comprises, consists, or consists essentially of the mature polypeptide of SEQ ID NO: 83, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 83 or the amino acid sequence of SEQ ID NO: 84, which has pectin acetyl esterase activity.

In an embodiment, the at least two polypeptides having pectinase activity comprises a polypeptide having rhamnogalacturonase activity and a polypeptide having pectin acetyl esterase activity, wherein the polypeptide having rhamnogalacturonase activity polynucleotide comprises, consists, or consists essentially of the mature polypeptide of SEQ ID NO: 59, or is a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 59 or the amino acid sequence of SEQ ID NO: 60, which has rhamnogalacturonase activity, and wherein the polypeptide having pectin acetyl esterase activity comprises, consists, or consists essentially of the mature polypeptide of SEQ ID NO: 86, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 86 or the amino acid sequence of SEQ ID NO: 87, which has pectin acetyl esterase activity.

In an embodiment, the at least one, at least two, or at least three polypeptides having pectinase activity are dosed in the range 0.1-1000 micro gram EP/g DS; 0.5-500 micro gram EP/g DS; 1-100 micro gram EP/g DS; such as 5-50 micro gram EP/g DS.

According to the invention at least one polypeptide having pectinase activity is present or added during fermentation or simultaneous saccharification and fermentation, however, preferred embodiments may also include the addition of other enzyme classes during fermentation/SSF. Examples of other enzymes that can be added during fermentation/SSF include, without limitation, alpha-amylases, glucoamylases, trehalases, cellulases/cellulolytic compositions. Particularly, saccharification and/or fermentation or simultaneous saccharification and fermentation, is performed in the presence of at least one cellulase/cellulolytic composition. More particularly the cellulases/cellulolytic composition are derived from a strain of *Trichoderma*, in particular *Trichoderma reesei*, or a strain of *Humicola*, in particular *Humicola insolens*, or a strain of *Chrysosporium*, in particular *Chrysosporium lucknowense*. The cellulases/cellulolytic composition should at least comprise a beta-glucosidase, a cellobiohydrolase and an endoglucanase.

In one embodiment, the cellulases/cellulolytic composition comprises one or more polypeptides selected from the group consisting of:

GH61 polypeptide having cellulolytic enhancing activity, beta-glucosidase;

Cellobiohydrolase I;

Cellobiohydrolase II;

or a mixture of two, three, or four thereof.

In an embodiment, the cellulase/cellulolytic composition comprises a beta-glucosidase, a cellobiohydrolase I, and an endoglucanase I.

Cellulases are well known in the art, and many are derived from filamentous fungi. Particularly, according to the invention, the cellulases/cellulolytic composition comprises one or more of the following components:

(i) an *Aspergillus fumigatus* cellobiohydrolase I;

(ii) an *Aspergillus fumigatus* cellobiohydrolase II;

(iii) an *Aspergillus fumigatus* beta-glucosidase or variant thereof; and (iv) a *Penicillium* sp. GH61 polypeptide having cellulolytic enhancing activity; or homologs thereof.

More specifically the cellulases/cellulolytic composition is in one embodiment a *Trichoderma reesei* cellulolytic enzyme composition further comprising *Penicillium emersonii* GH61A polypeptide having cellulolytic enhancing activity disclosed in SEQ ID NO: 109, or polypeptide having at least 80%, at least 85%, at least 90% identity, at least 95% identity, at least 96% identity, at least 97% identity, at least 99% identity to SEQ ID NO: 109 and an *Aspergillus fumigatus* beta-glucosidase disclosed in SEQ ID NO: 110 or a variant thereof with the following substitutions: F100D, S283G, N456E, F512Y having at least 90% identity, at least 95% identity, at least 96% identity, at least 97% identity, at least 99% identity to SEQ ID NO: 110.

In one embodiment, the cellulolytic composition comprises a cellobiohydrolase I (CBH I), such as one derived from a strain of the genus *Aspergillus*, such as a strain of *Aspergillus fumigatus*, such as the CBHI disclosed as SEQ ID NO: 111, or CBH I having at least 80%, at least 85%, at least 90% identity, at least 95% identity, at least 96% identity, at least 97% identity, at least 99% identity to SEQ ID NO: 111.

In one embodiment, the cellulolytic composition comprises a cellobiohydrolase II (CBH II), such as one derived from a strain of the genus *Aspergillus*, such as a strain of *Aspergillus fumigatus*; such as the CBH II disclosed as SEQ ID NO: 112, or a CBH II having at least 80%, at least 85%, at least 90% identity, at least 95% identity, at least 96% identity, at least 97% identity, at least 99% identity to SEQ ID NO: 112.

In another embodiment, the cellulases/cellulolytic composition is a *Trichoderma reesei* cellulolytic enzyme composition further comprising an endoglucanase I (EGI), such as one derived from a strain of the genus *Trichoderma*, such as a strain of *Trichoderma reesei*, such as the EGI disclosed as SEQ ID NO: 113, or an EGI having at least 80%, at least 85%, at least 90% identity, at least 95% identity, at least 96% identity, at least 97% identity, at least 99% identity to SEQ ID NO: 113.

Examples of suitable cellulases can be found in "Cellulolytic Composition present and/or added during Saccharification and/or Fermentation"

Examples of alpha-amylases can be found in the "Alpha-Amylase Present and/or Added During Liquefaction"-section below. Examples of thermostable proteases can be found in the "Protease Present and/or Added During Liquefaction"-section below. Examples of suitable optional carbohydrate-source generating enzymes, preferably thermostable carbohydrate-source generating enzymes, in particular, a thermostable glucoamylase, can be found in the "Carbohydrate-Source Generating Enzymes Present and/or Added During Liquefaction"-section below.

The pH during liquefaction may be between 4-7. In an embodiment the pH during liquefaction is from 4.5-5.0, such as between 4.5-4.8. In another embodiment liquefaction is carried out at a pH above 5.0-6.5, such as above 5.0-6.0, such as above 5.0-5.5, such as between 5.2-6.2, such as around 5.2, such as around 5.4, such as around 5.6, such as around 5.8.

According to the invention the temperature is above the initial gelatinization temperature. The term "initial gelatinization temperature" refers to the lowest temperature at which solubilization of starch, typically by heating, begins. The temperature can vary for different starches.

In an embodiment the temperature during liquefaction step i) is in the range from 70-100° C., such as between 75-95° C., such as between 75-90° C., preferably between 80-90° C., such as between 82-88° C., such as around 85° C. In an embodiment the temperature during liquefaction step i) is in the range from 70-100° C., such as between 75-100° C., preferably between 80-100° C., such as between 85-95° C., such as around between 88 and 92° C. In an embodiment, the temperature during liquefaction step i) is at least 80° C. In an embodiment, the temperature during liquefaction step i) is at least 81° C. In an embodiment, the temperature during liquefaction step i) is at least 82° C. In an embodiment, the temperature during liquefaction step i) is at least 83° C. In an embodiment, the temperature during liquefaction step i) is at least 84° C. In an embodiment, the temperature during liquefaction step i) is at least 85° C. In an embodiment, the temperature during liquefaction step i) is at least 86° C. In an embodiment, the temperature during liquefaction step i) is at least 87° C. In an embodiment, the temperature during liquefaction step i) is at least 88° C. In an embodiment, the temperature during liquefaction step i) is at least 89° C. In an embodiment, the temperature during liquefaction step i) is at least 90° C. In an embodiment, the temperature during liquefaction step i) is at least 91° C. In an embodiment, the temperature during liquefaction step i) is at least 92° C. In an embodiment, the temperature during liquefaction step i) is at least 93° C. In an embodiment, the temperature during liquefaction step i) is at least 94° C. In an embodiment, the temperature during liquefaction step i) is at least 95° C. In an embodiment, the temperature during liquefaction step i) is at least 96° C. In an embodiment, the temperature during liquefaction step i) is at least 97° C. In an embodiment, the temperature during liquefaction step i) is at least 97° C. In an embodiment, the temperature during liquefaction step i) is at least 98° C. In an embodiment, the temperature during liquefaction step i) is at least 99° C. In an embodiment, the temperature during liquefaction step i) is at least 100° C.

In an embodiment, the process of the invention further comprises, prior to the step i), the steps of:

a) reducing the particle size of the starch-containing material, preferably by dry milling;
b) forming a slurry comprising the starch-containing material and water.

The starch-containing starting material, such as whole grains, may be reduced in particle size, e.g., by milling, in order to open up the structure, to increase surface area, and allowing for further processing. Generally, there are two types of processes: wet and dry milling. In dry milling whole kernels are milled and used. Wet milling gives a good separation of germ and meal (starch granules and protein). Wet milling is often applied at locations where the starch hydrolysate is used in production of, e.g., syrups. Both dry and wet milling are well known in the art of starch processing. According to the present invention dry milling is preferred. In an embodiment the particle size is reduced to between 0.05 to 3.0 mm, preferably 0.1-0.5 mm, or so that at least 30%, preferably at least 50%, more preferably at least 70%, even more preferably at least 90% of the starch-containing material fit through a sieve with a 0.05 to 3.0 mm screen, preferably 0.1-0.5 mm screen. In another embodiment at least 50%, preferably at least 70%, more preferably at least 80%, especially at least 90% of the starch-containing material fit through a sieve with #6 screen.

The aqueous slurry may contain from 10-55 w/w-% dry solids (DS), preferably 25-45 w/w-% dry solids (DS), more preferably 30-40 w/w-% dry solids (DS) of starch-containing material.

The slurry may be heated to above the initial gelatinization temperature, preferably to between 80-90° C., between pH 4-7, preferably between 4.5-5.0 or 5.0 and 6.0, for 30 minutes to 5 hours, such as around 2 hours.

The alpha-amylase, optional thermostable protease, optional carbohydrate-source generating enzyme, in particular thermostable glucoamylase, may initially be added to the aqueous slurry to initiate liquefaction (thinning). In an embodiment only a portion of the enzymes is added to the aqueous slurry, while the rest of the enzymes are added during liquefaction step i).

Liquefaction step i) is according to the invention carried out for 0.5-5 hours, such as 1-3 hours, such as typically around 2 hours.

The aqueous slurry may in an embodiment be jet-cooked to further gelatinize the slurry before being subjected to liquefaction in step i). The jet-cooking may be carried out at a temperature between 110-145° C., preferably 120-140° C., such as 125-135° C., preferably around 130° C. for about 1-15 minutes, preferably for about 3-10 minutes, especially around about 5 minutes.

Saccharification and Fermentation

One or more carbohydrate-source generating enzymes, in particular glucoamylase, may be present and/or added during saccharification step ii) and/or fermentation step iii). The carbohydrate-source generating enzyme may preferably be a glucoamylase, but may also be an enzyme selected from the group consisting of: beta-amylase, maltogenic amylase and alpha-glucosidase. The carbohydrate-source generating enzyme added during saccharification step ii) and/or fermentation step iii) is typically different from the optional carbohydrate-source generating enzyme, in particular thermostable glucoamylase, optionally added during liquefaction step i). In a preferred embodiment the carbohydrate-source generating enzymes, in particular glucoamylase, is added together with a fungal alpha-amylase.

Examples of carbohydrate-source generating enzymes, including glucoamylases, can be found in the "Carbohydrate-Source Generating Enzyme Present and/or Added During Saccharification and/or Fermentation"-section below.

One or more alpha-amylases may be present and/or added during saccharification step ii) and/or fermentation step iii). In an embodiment, the alpha-amylase is the *Rhizomucor pusillus* alpha-amylase with *Aspergillus niger* glucoamylase linker and SBD disclosed as SEQ ID NO: 128 with the following substitutions: G128D+D143N (activity ratio AGU:AGU:FAU(F): approx. 30:7:1).

One or more trehalases may be present and/or added during saccharification step ii) and/or fermentation step iii). In an embodiment, the trehalase is the *Talaromyces funiculosus* trehalase disclosed herein as SEQ ID NO: 129.

In an embodiment, the trehalase is part of a blend comprising *Gloeophyllum sepiarium* glucoamylase disclosed in SEQ ID NO: 126, *Talaromyces funiculosus* trehalase disclosed herein as SEQ ID NO: 129, and *Rhizomucor pusillus* alpha-amylase with *Aspergillus niger* glucoamylase linker and SBD disclosed as SEQ ID NO: 128 with the following substitutions: G128D+D143N (activity ratio AGU:AGU: FAU(F): approx. 30:7:1).

When doing sequential saccharification and fermentation, saccharification step ii) may be carried out at conditions well-known in the art. For instance, the saccharification step ii) may last up to from about 24 to about 72 hours. In an embodiment pre-saccharification is done. Pre-saccharification is typically done for 40-90 minutes at a temperature between 30-65° C., typically about 60° C. Pre-saccharification is in an embodiment followed by saccharification during fermentation in simultaneous saccharification and fermentation ("SSF). Saccharification is typically carried out at temperatures from 20-75° C., preferably from 40-70° C., typically around 60° C., and at a pH between 4 and 5, normally at about pH 4.5.

Simultaneous saccharification and fermentation ("SSF") is widely used in industrial scale fermentation product production processes, especially ethanol production processes. When doing SSF the saccharification step ii) and the fermentation step iii) are carried out simultaneously. There is no holding stage for the saccharification, meaning that a fermenting organism, such as yeast, and enzyme(s), may be added together. However, it is also contemplated to add the fermenting organism and enzyme(s) separately. SSF is according to the invention typically carried out at a temperature from 25° C. to 40° C., such as from 28° C. to 35° C., such as from 30° C. to 34° C., preferably around about 32° C. In an embodiment fermentation is ongoing for 6 to 120 hours, in particular 24 to 96 hours. In an embodiment the pH is between 3.5-5, in particular between 3.8 and 4.3.

In an embodiment, the at least one polypeptide having pectinase activity has a pH optimum of less than 8.0, less than 7.5, less than 7.0, less than 6.5, less than 6.0, less than 5.5, less than or equal to about 5.0, less than or equal to about 4.9, less than or equal to about 4.9, less than or equal to about 4.8, less than or equal to about 4.8, less than or equal to about 4.7, less than or equal to about 4.6, or less than or equal to about 4.5. In an embodiment, the at least one polypeptide having polygalacturonase activity, e.g., from the GH28 family, has a pH optimum of less than 8.0, less than 7.5, less than 7.0, less than 6.5, less than 6.0, less than 5.5, less than or equal to about 5.0, less than or equal to about 4.9, less than or equal to about 4.9, less than or equal to about 4.8, less than or equal to about 4.8, less than or equal to about 4.7, less than or equal to about 4.6, or less than or equal to about 4.5. In an embodiment, the at least one polypeptide having rhamnogalacturonase activity, e.g., from the GH28 family, has a pH optimum of less than 8.0, less than 7.5, less than 7.0, less than 6.5, less than 6.0, less than 5.5, less than or equal to about 5.0, less than or equal to about 4.9, less than or equal to about 4.9, less than or equal to about 4.8, less than or equal to about 4.8, less than or equal to about 4.7, less than or equal to about 4.6, or less than or equal to about 4.5. In an embodiment, the at least one polypeptide having pectin methyl esterase activity, e.g., from the CE8 family, has a pH optimum of less than 8.0, less than 7.5, less than 7.0, less than 6.5, less than 6.0, less than 5.5, less than or equal to about 5.0, less than or equal to about 4.9, less than or equal to about 4.9, less than or equal to about 4.8, less than or equal to about 4.8, less than or equal to about 4.7, less than or equal to about 4.6, or less than or equal to about 4.5. In an embodiment, the at least one polypeptide having pectin lyase activity, e.g., from the PL1 family, has a pH optimum of less than 8.0, less than 7.5, less than 7.0, less than 6.5, less than 6.0, less than 5.5, less than or equal to about 5.0, less than or equal to about 4.9, less than or equal to about 4.9, less than or equal to about 4.8, less than or equal to about 4.8, less than or equal to about 4.7, less than or equal to about 4.6, or less than or equal to about 4.5. In an embodiment, the at least one polypeptide having pectin acetyl esterase activity, e.g., from the CE12 family or CE16 family, has a pH optimum of less than 8.0, less than 7.5, less than 7.0, less than 6.5, less than 6.0, less than 5.5, less than or equal to about 5.0, less than or equal to about 4.9, less than or equal to about 4.9, less than or equal to about 4.8, less than or equal to about 4.8, less than or equal to about 4.7, less than or equal to about 4.6, or less than or equal to about 4.5. In an embodiment, the at least one polypeptide having rhamnogalacturonan lyase activity, e.g., from the PL4 family, has a pH optimum of less than 8.0, less than 7.5, less than 7.0, less than 6.5, less than 6.0, less than 5.5, less than or equal to about 5.0, less than or equal to about 4.9, less than or equal to about 4.9, less than or equal to about 4.8, less than or equal to about 4.8, less than or equal to about 4.7, less than or equal to about 4.6, or less than or equal to about 4.5. In an embodiment, the at least one polypeptide having beta-galactanase activity, e.g., from the GH53 family, has a pH optimum of less than 8.0, less than 7.5, less than 7.0, less than 6.5, less than 6.0, less than 5.5, less than or equal to about 5.0, less than or equal to about 4.9, less than or equal to about 4.9, less than or equal to about 4.8, less than or equal to about 4.8, less than or equal to about 4.7, less than or equal to about 4.6, or less than or equal to about 4.5.

In an embodiment, the at least one polypeptide having pectinase activity has an isoelectric point (Pi) of less than 8.0, less than 7.5, less than 7.0, less than 6.5, less than 6.0, less than 5.5, less than or equal to about 5.0, less than or equal to about 4.9, less than or equal to about 4.9, less than or equal to about 4.8, less than or equal to about 4.8, less than or equal to about 4.7, less than or equal to about 4.6, or less than or equal to about 4.5. In an embodiment, the at least one polypeptide having polygalacturonase activity, e.g., from the GH28 family, has an isoelectric point (Pi) of less than 8.0, less than 7.5, less than 7.0, less than 6.5, less than 6.0, less than 5.5, less than or equal to about 5.0, less than or equal to about 4.9, less than or equal to about 4.9, less than or equal to about 4.8, less than or equal to about 4.8, less than or equal to about 4.7, less than or equal to about 4.6, or less than or equal to about 4.5. In an embodiment, the at least one polypeptide having rhamnogalacturonase activity, e.g., from the GH28 family, has an isoelectric point (Pi) of less than 8.0, less than 7.5, less than 7.0, less than 6.5, less than 6.0, less than 5.5, less than or equal to about 5.0, less than or equal to about 4.9, less than or equal to about 4.9, less than or equal to about 4.8, less than or equal to about 4.8, less than or equal to about 4.7, less than or equal to about 4.6, or less than or equal to about 4.5. In an embodiment, the at least one polypeptide having pectin methyl esterase activity, e.g., from the CE8 family, has an isoelectric point (Pi) of less than 8.0, less than 7.5, less than 7.0, less than 6.5, less than 6.0, less than 5.5, less than or equal to about 5.0, less than or equal to about 4.9, less than or equal to about 4.9, less than or equal to about 4.8, less than or equal to about 4.8, less than or equal to about 4.7, less than or equal to about 4.6, or less than or equal to about 4.5. In an embodiment, the at least one polypeptide having pectin lyase activity, e.g., from the PL1 family, has an isoelectric point (Pi) of less than 8.0, less than 7.5, less than 7.0, less than 6.5, less than 6.0, less than 5.5, less than or equal to about 5.0, less than or equal to about 4.9, less than or equal to about 4.9, less than or equal to about 4.8, less than or equal to about 4.8, less than or equal to about 4.7, less than or equal to about 4.6, or less than or equal to about 4.5. In an embodiment, the at least one polypeptide having pectin acetyl esterase activity, e.g., from the CE12 family or CE16 family, has an isoelectric point (Pi) of less than 8.0, less than 7.5, less than 7.0, less than 6.5, less than 6.0, less than 5.5, less than or equal to about 5.0, less than or equal to about 4.9, less than or equal to about 4.9, less than or equal to about 4.8, less than or equal to about 4.8, less than or equal to about 4.7, less than or equal to about 4.6, or less than or equal to about 4.5. In an embodiment, the at least one polypeptide having rhamnogalacturonan lyase activity, e.g., from the PL4 family, has an isoelectric point (Pi) of less than 8.0, less than 7.5, less than 7.0, less than 6.5, less than 6.0, less than 5.5, less than or equal to about 5.0, less than or equal to about 4.9, less than or equal to about 4.9, less than or equal to about 4.8, less than or equal to about 4.8, less than or equal to about 4.7, less than or equal to about 4.6, or less than or equal to about 4.5. In an embodiment, the at least one polypeptide having beta-galactanase activity, e.g., from the GH53 family, has an isoelectric point (Pi) of less than 8.0, less than 7.5, less than 7.0, less than 6.5, less than 6.0, less than 5.5, less than or equal to about 5.0, less than or equal to about 4.9, less than or equal to about 4.9, less than or equal to about 4.8, less than or equal to about 4.8, less than or equal to about 4.7, less than or equal to about 4.6, or less than or equal to about 4.5.

Methods Using a Cellulosic-Containing Material

In some aspects, the methods described herein produce a fermentation product from a cellulosic-containing material. The predominant polysaccharide in the primary cell wall of biomass is cellulose, the second most abundant is hemicellulose, and the third is pectin. The secondary cell wall, produced after the cell has stopped growing, also contains polysaccharides and is strengthened by polymeric lignin covalently cross-linked to hemicellulose. Cellulose is a homopolymer of anhydrocellobiose and thus a linear beta-(1-4)-D-glucan, while hemicelluloses include a variety of compounds, such as xylans, xyloglucans, arabinoxylans, and mannans in complex branched structures with a spectrum of substituents. Although generally polymorphous, cellulose is found in plant tissue primarily as an insoluble crystalline matrix of parallel glucan chains. Hemicelluloses usually hydrogen bond to cellulose, as well as to other hemicelluloses, which help stabilize the cell wall matrix.

Cellulose is generally found, for example, in the stems, leaves, hulls, husks, and cobs of plants or leaves, branches, and wood of trees. The cellulosic-containing material can be, but is not limited to, agricultural residue, herbaceous material (including energy crops), municipal solid waste, pulp and paper mill residue, waste paper, and wood (including forestry residue) (see, for example, Wiselogel et al., 1995, in Handbook on Bioethanol (Charles E. Wyman, editor), pp. 105-118, Taylor & Francis, Washington D.C.; Wyman, 1994, Bioresource Technology 50: 3-16; Lynd, 1990, Applied Biochemistry and Biotechnology 24/25: 695-719; Mosier et al., 1999, Recent Progress in Bioconversion of Lignocellulosics, in Advances in Biochemical Engineering/Biotechnology, T. Scheper, managing editor, Volume 65, pp. 23-40, Springer-Verlag, New York). It is understood herein that the cellulose may be in the form of lignocellulose, a plant cell wall material containing lignin, cellulose, and hemicellulose in a mixed matrix. In one embodiment, the cellulosic-containing material is any biomass material. In another embodiment, the cellulosic-containing material is lignocellulose, which comprises cellulose, hemicelluloses, and lignin.

In one embodiment, the cellulosic-containing material is agricultural residue, herbaceous material (including energy crops), municipal solid waste, pulp and paper mill residue, waste paper, or wood (including forestry residue).

In another embodiment, the cellulosic-containing material is arundo, bagasse, bamboo, corn cob, corn fiber, corn stover, miscanthus, rice straw, switchgrass, or wheat straw.

In another embodiment, the cellulosic-containing material is aspen, eucalyptus, fir, pine, poplar, spruce, or willow.

In another embodiment, the cellulosic-containing material is algal cellulose, bacterial cellulose, cotton linter, filter paper, microcrystalline cellulose (e.g., AVICEL®), or phosphoric-acid treated cellulose.

In another embodiment, the cellulosic-containing material is an aquatic biomass. As used herein the term "aquatic biomass" means biomass produced in an aquatic environment by a photosynthesis process. The aquatic biomass can be algae, emergent plants, floating-leaf plants, or submerged plants.

The cellulosic-containing material may be used as is or may be subjected to pretreatment, using conventional methods known in the art, as described herein. In a preferred embodiment, the cellulosic-containing material is pretreated.

The methods of using cellulosic-containing material can be accomplished using methods conventional in the art. Moreover, the methods of can be implemented using any conventional biomass processing apparatus configured to carry out the processes.

Cellulosic Pretreatment

In one embodiment the cellulosic-containing material is pretreated before saccharification in step (ii).

In practicing the processes described herein, any pretreatment process known in the art can be used to disrupt plant cell wall components of the cellulosic-containing material (Chandra et al., 2007, Adv. Biochem. Engin./Biotechnol. 108: 67-93; Galbe and Zacchi, 2007, Adv. Biochem. Engin./Biotechnol. 108: 41-65; Hendriks and Zeeman, 2009, Bioresource Technology 100: 10-18; Mosier et al., 2005, Bioresource Technology 96: 673-686; Taherzadeh and Karimi, 2008, Int. J. Mol. Sci. 9: 1621-1651; Yang and Wyman, 2008, Biofuels Bioproducts and Biorefining-Biofpr. 2: 26-40).

The cellulosic-containing material can also be subjected to particle size reduction, sieving, pre-soaking, wetting, washing, and/or conditioning prior to pretreatment using methods known in the art.

Conventional pretreatments include, but are not limited to, steam pretreatment (with or without explosion), dilute acid pretreatment, hot water pretreatment, alkaline pretreatment, lime pretreatment, wet oxidation, wet explosion, ammonia fiber explosion, organosolv pretreatment, and biological pretreatment. Additional pretreatments include ammonia percolation, ultrasound, electroporation, microwave, supercritical CO2, supercritical H2O, ozone, ionic liquid, and gamma irradiation pretreatments.

In a one embodiment, the cellulosic-containing material is pretreated before saccharification (i.e., hydrolysis) and/or fermentation. Pretreatment is preferably performed prior to the hydrolysis. Alternatively, the pretreatment can be carried out simultaneously with enzyme hydrolysis to release fermentable sugars, such as glucose, xylose, and/or cellobiose. In most cases the pretreatment step itself results in some conversion of biomass to fermentable sugars (even in absence of enzymes).

In one embodiment, the cellulosic-containing material is pretreated with steam. In steam pretreatment, the cellulosic-containing material is heated to disrupt the plant cell wall components, including lignin, hemicellulose, and cellulose to make the cellulose and other fractions, e.g., hemicellulose, accessible to enzymes. The cellulosic-containing material is passed to or through a reaction vessel where steam is injected to increase the temperature to the required temperature and pressure and is retained therein for the desired reaction time. Steam pretreatment is preferably performed at 140-250° C., e.g., 160-200° C. or 170-190° C., where the optimal temperature range depends on optional addition of a chemical catalyst. Residence time for the steam pretreatment is preferably 1-60 minutes, e.g., 1-30 minutes, 1-20 minutes, 3-12 minutes, or 4-10 minutes, where the optimal residence time depends on the temperature and optional addition of a chemical catalyst. Steam pretreatment allows for relatively high solids loadings, so that the cellulosic-containing material is generally only moist during the pretreatment. The steam pretreatment is often combined with an explosive discharge of the material after the pretreatment, which is known as steam explosion, that is, rapid flashing to atmospheric pressure and turbulent flow of the material to increase the accessible surface area by fragmentation (Duff and Murray, 1996, Bioresource Technology 855: 1-33; Galbe and Zacchi, 2002, Appl. Microbiol. Biotechnol. 59: 618-628; U.S. Patent Application No. 2002/0164730). During steam pretreatment, hemicellulose acetyl groups are cleaved and the resulting acid autocatalyzes partial hydrolysis of the hemicellulose to monosaccharides and oligosaccharides. Lignin is removed to only a limited extent.

In one embodiment, the cellulosic-containing material is subjected to a chemical pretreatment. The term "chemical treatment" refers to any chemical pretreatment that promotes the separation and/or release of cellulose, hemicellulose, and/or lignin. Such a pretreatment can convert crystalline cellulose to amorphous cellulose. Examples of suitable chemical pretreatment processes include, for example, dilute acid pretreatment, lime pretreatment, wet oxidation, ammonia fiber/freeze expansion (AFEX), ammonia percolation (APR), ionic liquid, and organosolv pretreatments.

A chemical catalyst such as H2SO4 or SO2 (typically 0.3 to 5% w/w) is sometimes added prior to steam pretreatment, which decreases the time and temperature, increases the recovery, and improves enzymatic hydrolysis (Ballesteros et al., 2006, Appl. Biochem. Biotechnol. 129-132: 496-508; Varga et al., 2004, Appl. Biochem. Biotechnol. 113-116: 509-523; Sassner et al., 2006, Enzyme Microb. Technol. 39: 756-762). In dilute acid pretreatment, the cellulosic-containing material is mixed with dilute acid, typically H2SO4, and water to form a slurry, heated by steam to the desired temperature, and after a residence time flashed to atmospheric pressure. The dilute acid pretreatment can be performed with a number of reactor designs, e.g., plug-flow reactors, counter-current reactors, or continuous counter-current shrinking bed reactors (Duff and Murray, 1996, Bioresource Technology 855: 1-33; Schell et al., 2004, Bioresource Technology 91: 179-188; Lee et al., 1999, Adv. Biochem. Eng. Biotechnol. 65: 93-115). In a specific embodiment the dilute acid pretreatment of cellulosic-containing material is carried out using 4% w/w sulfuric acid at 180° C. for 5 minutes.

Several methods of pretreatment under alkaline conditions can also be used. These alkaline pretreatments include, but are not limited to, sodium hydroxide, lime, wet oxidation, ammonia percolation (APR), and ammonia fiber/freeze expansion (AFEX) pretreatment. Lime pretreatment is performed with calcium oxide or calcium hydroxide at temperatures of 85-150° C. and residence times from one hour to several days (Wyman et al., 2005, Bioresource Technology 96: 1959-1966; Mosier et al., 2005, Bioresource Technology 96: 673-686). WO 2006/110891, WO 2006/110899, WO 2006/110900, and WO 2006/110901 disclose pretreatment methods using ammonia.

Wet oxidation is a thermal pretreatment performed typically at 180-200° C. for 5-15 minutes with addition of an oxidative agent such as hydrogen peroxide or over-pressure of oxygen (Schmidt and Thomsen, 1998, Bioresource Technology 64: 139-151; Palonen et al., 2004, Appl. Biochem. Biotechnol. 117: 1-17; Varga et al., 2004, Biotechnol. Bioeng. 88: 567-574; Martin et al., 2006, J. Chem. Technol. Biotechnol. 81: 1669-1677). The pretreatment is performed preferably at 1-40% dry matter, e.g., 2-30% dry matter or 5-20% dry matter, and often the initial pH is increased by the addition of alkali such as sodium carbonate.

A modification of the wet oxidation pretreatment method, known as wet explosion (combination of wet oxidation and steam explosion) can handle dry matter up to 30%. In wet explosion, the oxidizing agent is introduced during pretreatment after a certain residence time. The pretreatment is then ended by flashing to atmospheric pressure (WO2006/032282).

Ammonia fiber expansion (AFEX) involves treating the cellulosic-containing material with liquid or gaseous ammonia at moderate temperatures such as 90-150° C. and high pressure such as 17-20 bar for 5-10 minutes, where the dry matter content can be as high as 60% (Gollapalli et al., 2002, Appl. Biochem. Biotechnol. 98: 23-35; Chundawat et al., 2007, Biotechnol. Bioeng. 96: 219-231; Alizadeh et al., 2005, Appl. Biochem. Biotechnol. 121: 1133-1141; Teymouri et al., 2005, Bioresource Technology 96: 2014-2018). During AFEX pretreatment cellulose and hemicelluloses remain relatively intact. Lignin-carbohydrate complexes are cleaved.

Organosolv pretreatment delignifies the cellulosic-containing material by extraction using aqueous ethanol (40-60% ethanol) at 160-200° C. for 30-60 minutes (Pan et al., 2005, Biotechnol. Bioeng. 90: 473-481; Pan et al., 2006, Biotechnol. Bioeng. 94: 851-861; Kurabi et al., 2005, Appl. Biochem. Biotechnol. 121: 219-230). Sulphuric acid is usually added as a catalyst. In organosolv pretreatment, the majority of hemicellulose and lignin is removed.

Other examples of suitable pretreatment methods are described by Schell et al., 2003, Appl. Biochem. Biotechnol. 105-108: 69-85, and Mosier et al., 2005, Bioresource Technology 96: 673-686, and U.S. Published Application 2002/0164730.

In one embodiment, the chemical pretreatment is carried out as a dilute acid treatment, and more preferably as a continuous dilute acid treatment. The acid is typically sulfuric acid, but other acids can also be used, such as acetic acid, citric acid, nitric acid, phosphoric acid, tartaric acid, succinic acid, hydrogen chloride, or mixtures thereof. Mild acid treatment is conducted in the pH range of preferably 1-5, e.g., 1-4 or 1-2.5. In one aspect, the acid concentration is in the range from preferably 0.01 to 10 wt. % acid, e.g., 0.05 to 5 wt. % acid or 0.1 to 2 wt. % acid. The acid is contacted with the cellulosic-containing material and held at a temperature in the range of preferably 140-200° C., e.g., 165-190° C., for periods ranging from 1 to 60 minutes.

In another embodiment, pretreatment takes place in an aqueous slurry. In preferred aspects, the cellulosic-containing material is present during pretreatment in amounts preferably between 10-80 wt. %, e.g., 20-70 wt. % or 30-60 wt. %, such as around 40 wt. %. The pretreated cellulosic-containing material can be unwashed or washed using any method known in the art, e.g., washed with water.

In one embodiment, the cellulosic-containing material is subjected to mechanical or physical pretreatment. The term "mechanical pretreatment" or "physical pretreatment" refers to any pretreatment that promotes size reduction of particles. For example, such pretreatment can involve various types of grinding or milling (e.g., dry milling, wet milling, or vibratory ball milling).

The cellulosic-containing material can be pretreated both physically (mechanically) and chemically. Mechanical or physical pretreatment can be coupled with steaming/steam explosion, hydrothermolysis, dilute or mild acid treatment, high temperature, high pressure treatment, irradiation (e.g., microwave irradiation), or combinations thereof. In one aspect, high pressure means pressure in the range of preferably about 100 to about 400 psi, e.g., about 150 to about 250 psi. In another aspect, high temperature means temperature in the range of about 100 to about 300° C., e.g., about 140 to about 200° C. In a preferred aspect, mechanical or physical pretreatment is performed in a batch-process using a steam gun hydrolyzer system that uses high pressure and high temperature as defined above, e.g., a Sunds Hydrolyzer available from Sunds Defibrator AB, Sweden. The physical and chemical pretreatments can be carried out sequentially or simultaneously, as desired.

Accordingly, in one embodiment, the cellulosic-containing material is subjected to physical (mechanical) or chemical pretreatment, or any combination thereof, to promote the separation and/or release of cellulose, hemicellulose, and/or lignin.

In one embodiment, the cellulosic-containing material is subjected to a biological pretreatment. The term "biological pretreatment" refers to any biological pretreatment that promotes the separation and/or release of cellulose, hemicellulose, and/or lignin from the cellulosic-containing material. Biological pretreatment techniques can involve applying lignin-solubilizing microorganisms and/or enzymes (see, for example, Hsu, T.-A., 1996, Pretreatment of biomass, in Handbook on Bioethanol: Production and Utilization, Wyman, C. E., ed., Taylor & Francis, Washington, DC, 179-212; Ghosh and Singh, 1993, Adv. Appl. Microbiol. 39: 295-333; McMillan, J. D., 1994, Pretreating lignocellulosic biomass: a review, in Enzymatic Conversion of Biomass for Fuels Production, Himmel, M. E., Baker, J. O., and Overend, R. P., eds., ACS Symposium Series 566, American Chemical Society, Washington, DC, chapter 15; Gong, C. S., Cao, N. J., Du, J., and Tsao, G. T., 1999, Ethanol production from renewable resources, in Advances in Biochemical Engineering/Biotechnology, Scheper, T., ed., Springer-Verlag Berlin Heidelberg, Germany, 65: 207-241; Olsson and Hahn-Hagerdal, 1996, Enz. Microb. Tech. 18: 312-331; and Vallander and Eriksson, 1990, Adv. Biochem. Eng./Biotechnol. 42: 63-95).

Saccharification and Fermentation of Cellulosic-Containing Material

Saccharification (i.e., hydrolysis) and fermentation, separate or simultaneous, include, but are not limited to, separate hydrolysis and fermentation (SHF); simultaneous saccharification and fermentation (SSF); simultaneous saccharification and co-fermentation (SSCF); hybrid hydrolysis and fermentation (HHF); separate hydrolysis and co-fermentation (SHCF); hybrid hydrolysis and co-fermentation (HHCF).

SHF uses separate process steps to first enzymatically hydrolyze the cellulosic-containing material to fermentable sugars, e.g., glucose, cellobiose, and pentose monomers, and then ferment the fermentable sugars to ethanol. In SSF, the enzymatic hydrolysis of the cellulosic-containing material and the fermentation of sugars to ethanol are combined in one step (Philippidis, G. P., 1996, Cellulose bioconversion technology, in Handbook on Bioethanol: Production and Utilization, Wyman, C. E., ed., Taylor & Francis, Washington, DC, 179-212). SSCF involves the co-fermentation of multiple sugars (Sheehan and Himmel, 1999, Biotechnol. Prog. 15: 817-827). HHF involves a separate hydrolysis step, and in addition a simultaneous saccharification and hydrolysis step, which can be carried out in the same reactor. The steps in an HHF process can be carried out at different temperatures, i.e., high temperature enzymatic saccharification followed by SSF at a lower temperature that the fermentation organism can tolerate. It is understood herein that any method known in the art comprising pretreatment, enzymatic hydrolysis (saccharification), fermentation, or a combination thereof, can be used in the practicing the processes described herein.

A conventional apparatus can include a fed-batch stirred reactor, a batch stirred reactor, a continuous flow stirred reactor with ultrafiltration, and/or a continuous plug-flow column reactor (de Castilhos Corazza et al., 2003, Acta Scientiarum. Technology 25: 33-38; Gusakov and Sinitsyn, 1985, Enz. Microb. Technol. 7: 346-352), an attrition reactor (Ryu and Lee, 1983, Biotechnol. Bioeng. 25: 53-65). Additional reactor types include fluidized bed, upflow blanket, immobilized, and extruder type reactors for hydrolysis and/or fermentation.

In the saccharification step (i.e., hydrolysis step), the cellulosic and/or starch-containing material, e.g., pretreated or liquified, is hydrolyzed to break down cellulose, hemicellulose, and/or starch to fermentable sugars, such as glucose, cellobiose, xylose, xylulose, arabinose, mannose, galactose, and/or soluble oligosaccharides. The hydrolysis is performed enzymatically e.g., by a cellulolytic enzyme composition. The enzymes of the compositions can be added simultaneously or sequentially.

Enzymatic hydrolysis may be carried out in a suitable aqueous environment under conditions that can be readily determined by one skilled in the art. In one aspect, hydrolysis is performed under conditions suitable for the activity of the enzymes(s), i.e., optimal for the enzyme(s). The hydrolysis can be carried out as a fed batch or continuous process where the cellulosic and/or starch-containing material is fed gradually to, for example, an enzyme containing hydrolysis solution.

The saccharification is generally performed in stirred-tank reactors or fermentors under controlled pH, temperature, and mixing conditions. Suitable process time, temperature and pH conditions can readily be determined by one skilled in the art. For example, the saccharification can last up to 200 hours, but is typically performed for preferably about 12 to about 120 hours, e.g., about 16 to about 72 hours or about 24 to about 48 hours. The temperature is in the range of preferably about 25° C. to about 70° C., e.g., about 30° C. to about 65° C., about 40° C. to about 60° C., or about 50° C. to about 55° C. The pH is in the range of preferably about 3 to about 8, e.g., about 3.5 to about 7, about 4 to about 6, or about 4.5 to about 5.5. The dry solids content is in the range of preferably about 5 to about 50 wt. %, e.g., about 10 to about 40 wt. % or about 20 to about 30 wt. %.

Saccharification in step (ii) may be carried out using a cellulolytic enzyme composition. Such enzyme compositions are described below in the "Cellulolytic Enzyme Composition'-section below. The cellulolytic enzyme compositions can comprise any protein useful in degrading the cellulosic-containing material. In one aspect, the cellulolytic enzyme composition comprises or further comprises one or more (e.g., two, several) proteins selected from the group consisting of a cellulase, an AA9 (GH61) polypeptide, a hemicellulase, an esterase, an expansin, a ligninolytic enzyme, an oxidoreductase, a pectinase, a protease, and a swollenin.

In another embodiment, the cellulase is preferably one or more (e.g., two, several) enzymes selected from the group consisting of an endoglucanase, a cellobiohydrolase, and a beta-glucosidase.

In another embodiment, the hemicellulase is preferably one or more (e.g., two, several) enzymes selected from the group consisting of an acetylmannan esterase, an acetylxylan esterase, an arabinanase, an arabinofuranosidase, a coumaric acid esterase, a feruloyl esterase, a galactosidase, a glucuronidase, a glucuronoyl esterase, a mannanase, a mannosidase, a xylanase, and a xylosidase. In another embodiment, the oxidoreductase is one or more (e.g., two, several) enzymes selected from the group consisting of a catalase, a laccase, and a peroxidase.

The enzymes or enzyme compositions used in a processes of the present invention may be in any form suitable for use, such as, for example, a fermentation broth formulation or a cell composition, a cell lysate with or without cellular debris, a semi-purified or purified enzyme preparation, or a host cell as a source of the enzymes. The enzyme composition may be a dry powder or granulate, a non-dusting granulate, a liquid, a stabilized liquid, or a stabilized protected enzyme. Liquid enzyme preparations may, for instance, be stabilized by adding stabilizers such as a sugar, a sugar alcohol or another polyol, and/or lactic acid or another organic acid according to established processes.

In one embodiment, an effective amount of cellulolytic or hemicellulolytic enzyme composition to the cellulosic-containing material is about 0.5 to about 50 mg, e.g., about 0.5 to about 40 mg, about 0.5 to about 25 mg, about 0.75 to about 20 mg, about 0.75 to about 15 mg, about 0.5 to about 10 mg, or about 2.5 to about 10 mg per g of the cellulosic-containing material.

In one embodiment, such a compound is added at a molar ratio of the compound to glucosyl units of cellulose of about 10 6 to about 10, e.g., about 10 6 to about 7.5, about 10 6 to about 5, about 10 6 to about 2.5, about 10 6 to about 1, about 10 5 to about 1, about 10 5 to about 10 1, about 10 4 to about 10 1, about 10 3 to about 10 1, or about 10 3 to about 10 2. In another aspect, an effective amount of such a compound is about 0.1 μM to about 1 M, e.g., about 0.5 μM to about 0.75 M, about 0.75 μM to about 0.5 M, about 1 μM to about 0.25 M, about 1 μM to about 0.1 M, about 5 μM to about 50 mM, about 10 μM to about 25 mM, about 50 μM to about 25 mM, about 10 μM to about 10 mM, about 5 μM to about 5 mM, or about 0.1 mM to about 1 mM.

The term "liquor" means the solution phase, either aqueous, organic, or a combination thereof, arising from treatment of a lignocellulose and/or hemicellulose material in a slurry, or monosaccharides thereof, e.g., xylose, arabinose, mannose, etc., under conditions as described in WO 2012/021401, and the soluble contents thereof. A liquor for cellulolytic enhancement of an AA9 polypeptide (GH61 polypeptide) can be produced by treating a lignocellulose or hemicellulose material (or feedstock) by applying heat and/or pressure, optionally in the presence of a catalyst, e.g., acid, optionally in the presence of an organic solvent, and optionally in combination with physical disruption of the material, and then separating the solution from the residual solids. Such conditions determine the degree of cellulolytic enhancement obtainable through the combination of liquor and an AA9 polypeptide during hydrolysis of a cellulosic substrate by a cellulolytic enzyme preparation. The liquor can be separated from the treated material using a method standard in the art, such as filtration, sedimentation, or centrifugation.

In one embodiment, an effective amount of the liquor to cellulose is about 10 6 to about 10 g per g of cellulose, e.g., about 10 6 to about 7.5 g, about 10 6 to about 5 g, about 10 6 to about 2.5 g, about 10 6 to about 1 g, about 10 5 to about 1 g, about 10 5 to about 10 1 g, about 10 4 to about 10 1 g, about 10 3 to about 10 1 g, or about 10 3 to about 10 2 g per g of cellulose.

In the fermentation step, sugars, released from the cellulosic-containing material, e.g., as a result of the pretreatment and enzymatic hydrolysis steps, are fermented to ethanol, by a fermenting organism, such as yeast described herein. Hydrolysis (saccharification) and fermentation can be separate or simultaneous.

Any suitable hydrolyzed cellulosic-containing material can be used in the fermentation step in practicing the processes described herein. Such feedstocks include, but are not limited to carbohydrates (e.g., lignocellulose, xylans, cellulose, starch, etc.). The material is generally selected based on economics, i.e., costs per equivalent sugar potential, and recalcitrance to enzymatic conversion.

Production of ethanol by a fermenting organism using cellulosic-containing material results from the metabolism of sugars (monosaccharides). The sugar composition of the hydrolyzed cellulosic-containing material and the ability of the fermenting organism to utilize the different sugars has a direct impact in process yields.

Compositions of the fermentation media and fermentation conditions depend on the fermenting organism and can easily be determined by one skilled in the art. Typically, the fermentation takes place under conditions known to be suitable for generating the fermentation product. In some embodiments, the fermentation process is carried out under aerobic or microaerophilic (i.e., where the concentration of oxygen is less than that in air), or anaerobic conditions. In some embodiments, fermentation is conducted under anaerobic conditions (i.e., no detectable oxygen), or less than about 5, about 2.5, or about 1 mmol/L/h oxygen. In the absence of oxygen, the NADH produced in glycolysis cannot be oxidized by oxidative phosphorylation. Under anaerobic conditions, pyruvate or a derivative thereof may be utilized by the host cell as an electron and hydrogen acceptor in order to generate NAD+.

The fermentation process is typically run at a temperature that is optimal for the recombinant fungal cell. For example, in some embodiments, the fermentation process is performed at a temperature in the range of from about 25° C. to about 42° C. Typically the process is carried out a temperature that is less than about 38° C., less than about 35° C., less than about 33° C., or less than about 38° C., but at least about 20° C., 22° C., or 25° C.

A fermentation stimulator can be used in a process described herein to further improve the fermentation, and in particular, the performance of the fermenting organism, such as, rate enhancement and product yield (e.g., ethanol yield). A "fermentation stimulator" refers to stimulators for growth of the fermenting organisms, in particular, yeast. Preferred fermentation stimulators for growth include vitamins and minerals. Examples of vitamins include multivitamins, biotin, pantothenate, nicotinic acid, meso-inositol, thiamine, pyridoxine, para-aminobenzoic acid, folic acid, riboflavin, and Vitamins A, B, C, D, and E. See, for example, Alfenore et al., Improving ethanol production and viability of *Saccharomyces cerevisiae* by a vitamin feeding strategy during fed-batch process, Springer-Verlag (2002), which is hereby incorporated by reference. Examples of minerals include minerals and mineral salts that can supply nutrients comprising P, K, Mg, S, Ca, Fe, Zn, Mn, and Cu.

Fermentation Medium

"Fermentation media" or "fermentation medium" refers to the environment in which fermentation is carried out. The fermentation medium includes the fermentation substrate, that is, the carbohydrate source that is metabolized by the fermenting organism. According to the invention the fermentation medium may comprise nutrients and growth stimulator(s) for the fermenting organism(s). Nutrient and growth stimulators are widely used in the art of fermentation and include nitrogen sources, such as ammonia; urea, vitamins and minerals, or combinations thereof.

Fermenting Organisms

The term "Fermenting organism" refers to any organism, including bacterial and fungal organisms, especially yeast, suitable for use in a fermentation process and capable of producing the desired fermentation product. Especially suitable fermenting organisms are able to ferment, i.e., convert, sugars, such as glucose or maltose, directly or indirectly into the desired fermentation product, such as ethanol. Examples of fermenting organisms include fungal organisms, such as yeast. Preferred yeast includes strains of *Saccharomyces* spp., in particular, *Saccharomyces cerevisiae.*

Suitable concentrations of the viable fermenting organism during fermentation, such as SSF, are well known in the art or can easily be determined by the skilled person in the art. In one embodiment the fermenting organism, such as ethanol fermenting yeast, (e.g., *Saccharomyces cerevisiae*) is added to the fermentation medium so that the viable fermenting organism, such as yeast, count per mL of fermentation medium is in the range from 105 to 1012, preferably from 107 to 1010, especially about 5×107.

Examples of commercially available yeast includes, e.g., RED STAR™ and ETHANOL RED□ yeast (available from Fermentis/Lesaffre, USA), FALI (available from Fleischmann's Yeast, USA), SUPERSTART and THERMOSACC™ fresh yeast (available from Ethanol Technology, WI, USA), BIOFERM AFT and XR (available from NABC—North American Bioproducts Corporation, GA, USA), GERT STRAND (available from Gert Strand AB, Sweden), and FERMIOL (available from DSM Specialties). Other useful yeast strains are available from biological depositories such as the American Type Culture Collection (ATCC) or the Deutsche Sammlung von Mikroorganismen und Zellkulturen GmbH (DSMZ), such as, e.g., BY4741 (e.g., ATCC 201388); Y108-1 (ATCC PTA. 10567) and NRRL YB-1952 (ARS Culture Collection). Still other *S. cerevisiae* strains suitable as host cells DBY746, [Alpha][Eta]22, S150-2B, GPY55-15Ba, CEN.PK, USM21, TMB3500, TMB3400, VTT-A-63015, VTT-A-85068, VTT-c-79093 and their derivatives as well as *Saccharomyces* sp. 1400, 424A (LNH-ST), 259A (LNH-ST) and derivatives thereof.

As used herein, a "derivative" of strain is derived from a referenced strain, such as through mutagenesis, recombinant DNA technology, mating, cell fusion, or cytoduction between yeast strains. Those skilled in the art will understand that the genetic alterations, including metabolic modifications exemplified herein, may be described with reference to a suitable host organism and their corresponding metabolic reactions or a suitable source organism for desired genetic material such as genes for a desired metabolic pathway. However, given the complete genome sequencing of a wide variety of organisms and the high level of skill in the area of genomics, those skilled in the art can apply the teachings and guidance provided herein to other organisms. For example, the metabolic alterations exemplified herein can readily be applied to other species by incorporating the same or analogous encoding nucleic acid from species other than the referenced species.

The host cell or fermenting organism may be *Saccharomyces* strain, e.g., *Saccharomyces cerevisiae* strain produced using the method described and concerned in U.S. Pat. No. 8,257,959-BB. In one embodiment, the recombinant cell is a derivative of a strain *Saccharomyces cerevisiae* CIBTS1260 (deposited under Accession No. NRRL Y-50973 at the Agricultural Research Service Culture Collection (NRRL), Illinois 61604 U.S.A.).

The strain may also be a derivative of *Saccharomyces cerevisiae* strain NMI V14/004037 (See, WO2015/143324 and WO2015/143317 each incorporated herein by reference), strain nos. V15/004035, V15/004036, and V15/004037 (See, WO 2016/153924 incorporated herein by reference), strain nos. V15/001459, V15/001460, V15/001461 (See, WO2016/138437 incorporated herein by reference), strain no. NRRL Y67342 (See, WO2018/098381 incorporated herein by reference), strain nos. NRRL Y67549 and NRRL Y67700 (See, PCT/US2019/018249 incorporated herein by reference), or any strain described in WO2017/087330 (incorporated herein by reference).

The fermenting organisms may be a host cell that expresses a heterologous polypeptide having pectinase activity, e.g., a polygalacturonase, a rhamnogalacturonase, a pectin methyl esterase, a pectate lyase, a pectin acetyl esterase, a rhamnogalacturonan lyase, etc. (e.g., any polypeptide having pectinase activity described herein). Any polypeptide having pectinase activity contemplated for a process, enzyme blend, or composition described herein is also contemplated for expression by a fermenting organism or host cell.

In one embodiment is a recombinant host cell comprising a heterologous polynucleotide encoding a polypeptide having pectinase activity, e.g., a polygalacturonase, a rhamnogalacturonase, a pectin methyl esterase, a pectate lyase, a pectin acetyl esterase, a rhamnogalacturonan lyase, etc. (e.g., any polypeptide having pectinase activity described herein).

In one embodiment is a recombinant yeast host cell comprising a heterologous polynucleotide encoding a polypeptide having polygalacturonase activity, wherein the polynucleotide comprises, consists, or consists essentially of the nucleotide sequence of SEQ ID NO: 1, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 1, which has polygalacturonase activity.

In one embodiment is a recombinant yeast host cell comprising a heterologous polynucleotide encoding a polypeptide having polygalacturonase activity, wherein the polynucleotide comprises, consists, or consists essentially of the nucleotide sequence of SEQ ID NO: 4, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 4, which has polygalacturonase activity.

In one embodiment is a recombinant yeast host cell comprising a heterologous polynucleotide encoding a polypeptide having polygalacturonase activity, wherein the polynucleotide comprises, consists, or consists essentially of the nucleotide sequence of SEQ ID NO: 7, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 7, which has polygalacturonase activity.

In one embodiment is a recombinant yeast host cell comprising a heterologous polynucleotide encoding a polypeptide having polygalacturonase activity, wherein the polynucleotide comprises, consists, or consists essentially of the nucleotide sequence of SEQ ID NO: 10, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 10, which has polygalacturonase activity.

In one embodiment is a recombinant yeast host cell comprising a heterologous polynucleotide encoding a polypeptide having polygalacturonase activity, wherein the polynucleotide comprises, consists, or consists essentially of the nucleotide sequence of SEQ ID NO: 13, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 13, which has polygalacturonase activity.

In one embodiment is a recombinant yeast host cell comprising a heterologous polynucleotide encoding a polypeptide having polygalacturonase activity, wherein the polynucleotide comprises, consists, or consists essentially of the nucleotide sequence of SEQ ID NO: 16, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 16, which has polygalacturonase activity.

In one embodiment is a recombinant yeast host cell comprising a heterologous polynucleotide encoding a polypeptide having polygalacturonase activity, wherein the polynucleotide comprises, consists, or consists essentially of the nucleotide sequence of SEQ ID NO: 19, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 19, which has polygalacturonase activity.

In one embodiment is a recombinant yeast host cell comprising a heterologous polynucleotide encoding a polypeptide having polygalacturonase activity, wherein the polynucleotide comprises, consists, or consists essentially of the nucleotide sequence of SEQ ID NO: 22, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 22, which has polygalacturonase activity.

In one embodiment is a recombinant yeast host cell comprising a heterologous polynucleotide encoding a polypeptide having polygalacturonase activity, wherein the polynucleotide comprises, consists, or consists essentially of the nucleotide sequence of SEQ ID NO: 25, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 25, which has polygalacturonase activity.

In one embodiment is a recombinant yeast host cell comprising a heterologous polynucleotide encoding a polypeptide having polygalacturonase activity, wherein the polynucleotide comprises, consists, or consists essentially of the nucleotide sequence of SEQ ID NO: 28, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 28, which has polygalacturonase activity.

In one embodiment is a recombinant yeast host cell comprising a heterologous polynucleotide encoding a polypeptide having polygalacturonase activity, wherein the polynucleotide comprises, consists, or consists essentially of the nucleotide sequence of SEQ ID NO: 31, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 31, which has polygalacturonase activity.

In one embodiment is a recombinant yeast host cell comprising a heterologous polynucleotide encoding a polypeptide having polygalacturonase activity, wherein the polynucleotide comprises, consists, or consists essentially of the nucleotide sequence of SEQ ID NO: 34, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 34, which has polygalacturonase activity.

In one embodiment is a recombinant yeast host cell comprising a heterologous polynucleotide encoding a polypeptide having polygalacturonase activity, wherein the polynucleotide comprises, consists, or consists essentially of the nucleotide sequence of SEQ ID NO: 37, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 37, which has polygalacturonase activity.

In one embodiment is a recombinant yeast host cell comprising a heterologous polynucleotide encoding a polypeptide having polygalacturonase activity, wherein the polynucleotide comprises, consists, or consists essentially of the nucleotide sequence of SEQ ID NO: 40, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 40, which has polygalacturonase activity.

In one embodiment is a recombinant yeast host cell comprising a heterologous polynucleotide encoding a polypeptide having polygalacturonase activity, wherein the polynucleotide comprises, consists, or consists essentially of the nucleotide sequence of SEQ ID NO: 43, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 43, which has polygalacturonase activity.

In one embodiment is a recombinant yeast host cell comprising a heterologous polynucleotide encoding a polypeptide having polygalacturonase activity, wherein the polynucleotide comprises, consists, or consists essentially of the nucleotide sequence of SEQ ID NO: 142, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 142, which has polygalacturonase activity.

In one embodiment is a recombinant yeast host cell comprising a heterologous polynucleotide encoding a polypeptide having rhamnogalacturonase activity, wherein the polynucleotide comprises, consists, or consists essentially of the nucleotide sequence of SEQ ID NO: 46, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 46, which has rhamnogalacturonase activity.

In one embodiment is a recombinant yeast host cell comprising a heterologous polynucleotide encoding a polypeptide having rhamnogalacturonase activity, wherein the polynucleotide comprises, consists, or consists essentially of the nucleotide sequence of SEQ ID NO: 49, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 49, which has rhamnogalacturonase activity.

In one embodiment is a recombinant yeast host cell comprising a heterologous polynucleotide encoding a polypeptide having rhamnogalacturonase activity, wherein the polynucleotide comprises, consists, or consists essentially of the nucleotide sequence of SEQ ID NO: 52, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 52, which has rhamnogalacturonase activity.

In one embodiment is a recombinant yeast host cell comprising a heterologous polynucleotide encoding a polypeptide having rhamnogalacturonase activity, wherein the polynucleotide comprises, consists, or consists essentially of the nucleotide sequence of SEQ ID NO: 55, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 55, which has rhamnogalacturonase activity.

In one embodiment is a recombinant yeast host cell comprising a heterologous polynucleotide encoding a polypeptide having rhamnogalacturonase activity, wherein the polynucleotide comprises, consists, or consists essentially of the nucleotide sequence of SEQ ID NO: 58, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 58, which has rhamnogalacturonase activity.

In one embodiment is a recombinant yeast host cell comprising a heterologous polynucleotide encoding a polypeptide having rhamnogalacturonase activity, wherein the polynucleotide comprises, consists, or consists essentially of the nucleotide sequence of SEQ ID NO: 61, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 61, which has rhamnogalacturonase activity.

In one embodiment is a recombinant yeast host cell comprising a heterologous polynucleotide encoding a polypeptide having rhamnogalacturonase activity, wherein the polynucleotide comprises, consists, or consists essentially of the nucleotide sequence of SEQ ID NO: 133, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 133, which has rhamnogalacturonase activity.

In one embodiment is a recombinant yeast host cell comprising a heterologous polynucleotide encoding a polypeptide having rhamnogalacturonase activity, wherein the polynucleotide comprises, consists, or consists essentially of the nucleotide sequence of SEQ ID NO: 145, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 145, which has rhamnogalacturonase activity.

In one embodiment is a recombinant yeast host cell comprising a heterologous polynucleotide encoding a polypeptide having pectin methyl esterase activity, wherein the polynucleotide comprises, consists, or consists essentially of the nucleotide sequence of SEQ ID NO: 64, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 64, which has pectin methyl esterase activity.

In one embodiment is a recombinant yeast host cell comprising a heterologous polynucleotide encoding a polypeptide having pectin methyl esterase activity, wherein the polynucleotide comprises, consists, or consists essentially of the nucleotide sequence of SEQ ID NO: 67, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 67, which has pectin methyl esterase activity.

In one embodiment is a recombinant yeast host cell comprising a heterologous polynucleotide encoding a polypeptide having pectin methyl esterase activity, wherein the polynucleotide comprises, consists, or consists essentially of the nucleotide sequence of SEQ ID NO: 70, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 70, which has pectin methyl esterase activity.

In one embodiment is a recombinant yeast host cell comprising a heterologous polynucleotide encoding a polypeptide having pectin methyl esterase activity, wherein the polynucleotide comprises, consists, or consists essentially of the nucleotide sequence of SEQ ID NO: 73, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 73, which has pectin methyl esterase activity.

In one embodiment is a recombinant yeast host cell comprising a heterologous polynucleotide encoding a polypeptide having pectin lyase activity, wherein the polynucleotide comprises, consists, or consists essentially of the nucleotide sequence of SEQ ID NO: 76, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 76, which has pectin lyase activity.

In one embodiment is a recombinant yeast host cell comprising a heterologous polynucleotide encoding a polypeptide having pectin lyase activity, wherein the polynucleotide comprises, consists, or consists essentially of the nucleotide sequence of SEQ ID NO: 79, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 79, which has pectin lyase activity.

In one embodiment is a recombinant yeast host cell comprising a heterologous polynucleotide encoding a polypeptide having pectin lyase activity, wherein the polynucleotide comprises, consists, or consists essentially of the nucleotide sequence of SEQ ID NO: 106, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 106, which has pectin lyase activity.

In one embodiment is a recombinant yeast host cell comprising a heterologous polynucleotide encoding a polypeptide having pectin acetyl esterase activity, wherein the polynucleotide comprises, consists, or consists essentially of the nucleotide sequence of SEQ ID NO: 82, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 82, which has pectin acetyl esterase activity.

In one embodiment is a recombinant yeast host cell comprising a heterologous polynucleotide encoding a polypeptide having pectin acetyl esterase activity, wherein the polynucleotide comprises, consists, or consists essentially of the nucleotide sequence of SEQ ID NO: 85, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 85, which has pectin acetyl esterase activity.

In one embodiment is a recombinant yeast host cell comprising a heterologous polynucleotide encoding a polypeptide having pectin acetyl esterase activity, wherein the polynucleotide comprises, consists, or consists essentially of the nucleotide sequence of SEQ ID NO: 88, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 88, which has pectin acetyl esterase activity.

In one embodiment is a recombinant yeast host cell comprising a heterologous polynucleotide encoding a polypeptide having rhamnogalacturonan lyase activity, wherein the polynucleotide comprises, consists, or consists essentially of the nucleotide sequence of SEQ ID NO: 94, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 94, which has rhamnogalacturonan lyase activity.

In one embodiment is a recombinant yeast host cell comprising a heterologous polynucleotide encoding a polypeptide having rhamnogalacturonan lyase activity, wherein the polynucleotide comprises, consists, or consists essentially of the nucleotide sequence of SEQ ID NO: 97, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 97, which has rhamnogalacturonan lyase activity.

In one embodiment is a recombinant yeast host cell comprising a heterologous polynucleotide encoding a polypeptide having rhamnogalacturonan lyase activity, wherein the polynucleotide comprises, consists, or consists essentially of the nucleotide sequence of SEQ ID NO: 100, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 100, which has rhamnogalacturonan lyase activity.

In one embodiment is a recombinant yeast host cell comprising a heterologous polynucleotide encoding a polypeptide having rhamnogalacturonan lyase activity, wherein the polynucleotide comprises, consists, or consists essentially of the nucleotide sequence of SEQ ID NO: 136, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 136, which has rhamnogalacturonan lyase activity.

In one embodiment is a recombinant yeast host cell comprising a heterologous polynucleotide encoding a polypeptide having rhamnogalacturonan lyase activity, wherein the polynucleotide comprises, consists, or consists essentially of the nucleotide sequence of SEQ ID NO: 139, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 139, which has rhamnogalacturonan lyase activity.

In one embodiment is a recombinant yeast host cell comprising a heterologous polynucleotide encoding a polypeptide having beta-galactanase activity, wherein the polynucleotide comprises, consists, or consists essentially of the nucleotide sequence of SEQ ID NO: 103, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 103, which has beta-galactanase activity.

In one embodiment is a recombinant yeast host cell comprising a heterologous polynucleotide encoding a polypeptide having polygalacturonase activity and a heterologous polynucleotide encoding a polypeptide having pectin methyl esterase activity.

In one embodiment is a recombinant yeast host cell comprising a heterologous polynucleotide encoding a polypeptide having polygalacturonase activity and a heterologous polynucleotide encoding a polypeptide having pectin methyl esterase activity, wherein the polygalacturonase is selected from the group consisting of a polygalacturonase I, polygalacturonase II, polygalacturonase III, and polygalacturonase IV.

In one embodiment is a recombinant yeast host cell comprising a heterologous polynucleotide encoding a polypeptide having polygalacturonase activity and a heterologous polynucleotide encoding a polypeptide having pectin methyl esterase activity, wherein the heterologous polynucleotide encoding the polypeptide having polygalacturonase activity is from a strain of *Aspergillus*, and wherein the heterologous polynucleotide encoding the polypeptide having pectin methyl esterase is from a strain of *Aspergillus*.

In one embodiment is a recombinant yeast host cell comprising a heterologous polynucleotide encoding a polypeptide having polygalacturonase activity and a heterologous polynucleotide encoding a polypeptide having pectin methyl esterase activity, wherein the heterologous polynucleotide encoding the polypeptide having polygalacturonase activity is from a strain selected from the group consisting of *Aspergillus aculeatus* and *Aspergillus niger*, and wherein the heterologous polynucleotide encoding the polypeptide having pectin methyl esterase is from a strain selected from the group consisting of *Aspergillus aculeatus* and *Aspergillus niger.*

In one embodiment is a recombinant yeast host cell comprising a first heterologous polynucleotide encoding a polypeptide having polygalacturonase activity and a second heterologous polynucleotide encoding a polypeptide having pectin methyl esterase activity, wherein the first heterologous polynucleotide comprises, consists, or consists essentially of the nucleotide sequence of SEQ ID NO: 4, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 4, which has polygalacturonase activity, and wherein the second heterologous polynucleotide comprises, consists, or consists essentially of the nucleotide sequence of SEQ ID NO: 64, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 64, which has pectin methyl esterase activity.

In one embodiment is a recombinant yeast host cell comprising a first heterologous polynucleotide encoding a polypeptide having polygalacturonase activity and a second heterologous polynucleotide encoding a polypeptide having pectin methyl esterase activity, wherein the first heterologous polynucleotide comprises, consists, or consists essentially of the nucleotide sequence of SEQ ID NO: 1, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 1, which has polygalacturonase activity, and wherein the second heterologous polynucleotide comprises, consists, or consists essentially of the nucleotide sequence of SEQ ID NO: 64, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 64, which has pectin methyl esterase activity.

In one embodiment is a recombinant yeast host cell comprising a heterologous polynucleotide encoding a polypeptide having rhamnogalacturonase activity and a heterologous polynucleotide encoding a polypeptide having pectin acetyl esterase activity.

In one embodiment is a recombinant yeast host cell comprising a heterologous polynucleotide encoding a polypeptide having rhamnogalacturonase activity and a heterologous polynucleotide encoding a polypeptide having pectin acetyl esterase activity, wherein the rhamnogalacturonase is from the GH28 family, and wherein the pectin acetyl esterase is from the CE12 family.

In one embodiment is a recombinant yeast host cell comprising a heterologous polynucleotide encoding a polypeptide having rhamnogalacturonase activity and a heterologous polynucleotide encoding a polypeptide having pectin acetyl esterase activity, wherein the heterologous polynucleotide encoding the polypeptide having rhamnogalacturonase activity is from a strain selected from the group consisting of *Talaromyces* and *Penicillium*, and wherein the heterologous polynucleotide encoding the polypeptide having pectin acetyl esterase is from a strain of *Aspergillus*.

In one embodiment is a recombinant yeast host cell comprising a heterologous polynucleotide encoding a polypeptide having rhamnogalacturonase activity and a heterologous polynucleotide encoding a polypeptide having pectin acetyl esterase activity, wherein the heterologous polynucleotide encoding the polypeptide having rhamnogalacturonase activity is from a strain selected from the group consisting of *Talaromyces calidicanius, Penicillium* sp. XZ2495, *Penicillium* sp-54788, and *Talaromyces* sp. XZ2925 and wherein the heterologous polynucleotide encoding the polypeptide having pectin acetyl esterase is from a strain of *Aspergillus aculeatus.*

In one embodiment is a recombinant yeast host cell comprising a first heterologous polynucleotide encoding a polypeptide having rhamnogalacturonase activity and a second heterologous polynucleotide encoding a polypeptide having pectin acetyl esterase activity, wherein the first heterologous polynucleotide comprises, consists, or consists essentially of the nucleotide sequence of SEQ ID NO: 52, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 52, which has rhamnogalacturonase activity, and wherein the second heterologous polynucleotide comprises, consists, or consists essentially of the nucleotide sequence of SEQ ID NO: 82, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 82, which has pectin acetyl esterase activity.

In one embodiment is a recombinant yeast host cell comprising a first heterologous polynucleotide encoding a polypeptide having rhamnogalacturonase activity and a second heterologous polynucleotide encoding a polypeptide having pectin acetyl esterase activity, wherein the first heterologous polynucleotide comprises, consists, or consists essentially of the nucleotide sequence of SEQ ID NO: 52, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 52, which has rhamnogalacturonase activity, and wherein the second heterologous polynucleotide comprises, consists, or consists essentially of the nucleotide sequence of SEQ ID NO: 85, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 85, which has pectin acetyl esterase activity.

In one embodiment is a recombinant yeast host cell comprising a first heterologous polynucleotide encoding a polypeptide having rhamnogalacturonase activity and a second heterologous polynucleotide encoding a polypeptide having pectin acetyl esterase activity, wherein the first heterologous polynucleotide comprises, consists, or consists essentially of the nucleotide sequence of SEQ ID NO: 55, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 55, which has rhamnogalacturonase activity, and wherein the second heterologous polynucleotide comprises, consists, or consists essentially of the nucleotide sequence of SEQ ID NO: 82, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 82, which has pectin acetyl esterase activity.

In one embodiment is a recombinant yeast host cell comprising a first heterologous polynucleotide encoding a polypeptide having rhamnogalacturonase activity and a second heterologous polynucleotide encoding a polypeptide having pectin acetyl esterase activity, wherein the first heterologous polynucleotide comprises, consists, or consists essentially of the nucleotide sequence of SEQ ID NO: 55, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 55, which has rhamnogalacturonase activity, and wherein the second heterologous polynucleotide comprises, consists, or consists essentially of the nucleotide sequence of SEQ ID NO: 85, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 85, which has pectin acetyl esterase activity.

In one embodiment is a recombinant yeast host cell comprising a first heterologous polynucleotide encoding a polypeptide having rhamnogalacturonase activity and a second heterologous polynucleotide encoding a polypeptide having pectin acetyl esterase activity, wherein the first heterologous polynucleotide comprises, consists, or consists essentially of the nucleotide sequence of SEQ ID NO: 58, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 58, which has rhamnogalacturonase activity, and wherein the second heterologous polynucleotide comprises, consists, or consists essentially of the nucleotide sequence of SEQ ID NO: 82, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 82, which has pectin acetyl esterase activity.

In one embodiment is a recombinant yeast host cell comprising a first heterologous polynucleotide encoding a polypeptide having rhamnogalacturonase activity and a second heterologous polynucleotide encoding a polypeptide having pectin acetyl esterase activity, wherein the first heterologous polynucleotide comprises, consists, or consists essentially of the nucleotide sequence of SEQ ID NO: 58, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 58, which has rhamnogalacturonase activity, and wherein the second heterologous polynucleotide comprises, consists, or consists essentially of the nucleotide sequence of SEQ ID NO: 85, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 85, which has pectin acetyl esterase activity.

In one embodiment is a recombinant yeast host cell comprising a heterologous polynucleotide encoding a polypeptide having rhamnogalacturon lyase activity, a heterologous polynucleotide encoding a polypeptide having polygalacturonase activity and a heterologous polynucleotide encoding a polypeptide having pectin lyase.

In one embodiment is a recombinant yeast host cell comprising a heterologous polynucleotide encoding a polypeptide having rhamnogalacturon lyase activity, a heterologous polynucleotide encoding a polypeptide having polygalacturonase activity and a heterologous polynucleotide encoding a polypeptide having pectin lyase activity, wherein the heterologous polynucleotide encoding the polypeptide having rhamnogalacturon lyase activity is from a strain of *Sporormia*, wherein the heterologous polynucleotide encoding the polypeptide having polygalacturonase activity is from a strain of *Penicillium*, and wherein the heterologous polynucleotide encoding the polypeptide having pectin lyase activity is from a strain of *Thielavia*.

In one embodiment is a recombinant yeast host cell comprising a heterologous polynucleotide encoding a polypeptide having rhamnogalacturon lyase activity, a heterologous polynucleotide encoding a polypeptide having polygalacturonase activity and a heterologous polynucleotide encoding a polypeptide having pectin lyase activity, wherein the heterologous polynucleotide encoding the polypeptide having rhamnogalacturon lyase activity is from a strain of *Sporormia fimetaria*, wherein the heterologous polynucleotide encoding the polypeptide having polygalacturonase activity is from a strain of *Penicillium oxalicum*, and wherein the heterologous polynucleotide encoding the polypeptide having pectin lyase activity is from a strain of *Thielavia hyrcaniae*.

In one embodiment is a recombinant yeast host cell comprising a heterologous polynucleotide encoding a polypeptide having rhamnogalacturon lyase activity, a heterologous polynucleotide encoding a polypeptide having polygalacturonase activity and a heterologous polynucleotide encoding a polypeptide having pectin lyase activity, wherein the heterologous polynucleotide encoding the polypeptide having rhamnogalacturon lyase activity comprises, consists, or consists essentially of the nucleotide sequence of SEQ ID NO: 139, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 142, which has polygalacturonase activity, wherein the heterologous polynucleotide encoding the polypeptide having polygalacturonase activity comprises, consists, or consists essentially of the nucleotide sequence of SEQ ID NO: 142, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 142, which has polygalacturonase activity, and wherein the heterologous polynucleotide encoding the polypeptide having pectin lyase activity comprises, consists, or consists essentially of the nucleotide sequence of SEQ ID NO: 76, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 76, which has pectin lyase activity.

In some embodiments, the host cells and/or fermenting organisms comprise one or more heterologous polynucleotides encoding an alpha-amylase, glucoamylase, protease and/or cellulase. Examples of alpha-amylase, glucoamylase, protease and cellulases suitable for expression in the host cells and/or fermenting organisms are described in more detail herein.

In one embodiment is a recombinant yeast host cell comprising:

(i) a first heterologous polynucleotide encoding a polypeptide having polygalacturonase activity, wherein the first heterologous polynucleotide comprises, consists, or consists essentially of the nucleotide sequence of SEQ ID NO: 4, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 4, which has polygalacturonase activity;

(ii) a second heterologous polynucleotide encoding a polypeptide having pectin methyl esterase activity, wherein the second heterologous polynucleotide comprises, consists, or consists essentially of the nucleotide sequence of SEQ ID NO: 64, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 64, which has pectin methyl esterase activity;

(iii) a third heterologous polynucleotide encoding a polypeptide having glucoamylase activity, wherein the second heterologous polynucleotide comprises, consists, or consists essentially of the nucleotide sequence of SEQ ID NO: 131, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 131, which has glucoamylase activity; and (iv) a fourth heterologous polynucleotide encoding a polypeptide having alpha-amylase activity, wherein the second heterologous polynucleotide comprises, consists, or consists essentially of the nucleotide sequence of SEQ ID NO: 132, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 132, which has alpha-amylase activity.

In one embodiment is a recombinant yeast host cell comprising:

(i) a first heterologous polynucleotide encoding a polypeptide having polygalacturonase activity, wherein the first heterologous polynucleotide comprises, consists, or consists essentially of the nucleotide sequence of SEQ ID NO: 1, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 1, which has polygalacturonase activity;

(ii) a second heterologous polynucleotide encoding a polypeptide having pectin methyl esterase activity, wherein the second heterologous polynucleotide comprises, consists, or consists essentially of the nucleotide sequence of SEQ ID NO: 64, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 64, which has pectin methyl esterase activity;

(iii) a third heterologous polynucleotide encoding a polypeptide having glucoamylase activity, wherein the second heterologous polynucleotide comprises, consists, or consists essentially of the nucleotide sequence of SEQ ID NO: 131, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 131, which has glucoamylase activity; and (iv) a fourth heterologous polynucleotide encoding a polypeptide having alpha-amylase activity, wherein the second heterologous polynucleotide comprises, consists, or consists essentially of the nucleotide sequence of SEQ ID NO: 132, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 132, which has alpha-amylase activity.

In one embodiment is a recombinant yeast host cell comprising:

(i) a first heterologous polynucleotide encoding a polypeptide having rhamnogalacturonase activity, wherein the first heterologous polynucleotide comprises, consists, or consists essentially of the nucleotide sequence of SEQ ID NO: 52, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 52, which has rhamnogalacturonase activity;

(ii) a second heterologous polynucleotide encoding a polypeptide having pectin acetyl esterase activity, wherein the second heterologous polynucleotide comprises, consists, or consists essentially of the nucleotide sequence of SEQ ID NO: 82, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 82, which has pectin acetyl esterase activity;

(iii) a third heterologous polynucleotide encoding a polypeptide having glucoamylase activity, wherein the second heterologous polynucleotide comprises, consists, or consists essentially of the nucleotide sequence of SEQ ID NO: 131, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 131, which has glucoamylase activity; and (iv) a fourth heterologous polynucleotide encoding a polypeptide having alpha-amylase activity, wherein the second heterologous polynucleotide comprises, consists, or consists essentially of the nucleotide sequence of SEQ ID NO: 132, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 132, which has alpha-amylase activity.

In one embodiment is a recombinant yeast host cell comprising:

(i) a first heterologous polynucleotide encoding a polypeptide having rhamnogalacturonase activity, wherein the first heterologous polynucleotide comprises, consists, or consists essentially of the nucleotide sequence of SEQ ID NO: 52, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 52, which has rhamnogalacturonase activity;

(ii) a second heterologous polynucleotide encoding a polypeptide having pectin acetyl esterase activity, wherein the second heterologous polynucleotide comprises, consists, or consists essentially of the nucleotide sequence of SEQ ID NO: 85, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 85, which has pectin acetyl esterase activity;

(iii) a third heterologous polynucleotide encoding a polypeptide having glucoamylase activity, wherein the second heterologous polynucleotide comprises, consists, or consists essentially of the nucleotide sequence of SEQ ID NO: 131, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 131, which has glucoamylase activity; and (iv) a fourth heterologous polynucleotide encoding a polypeptide having alpha-amylase activity, wherein the second heterologous polynucleotide comprises, consists, or consists essentially of the nucleotide sequence of SEQ ID NO: 132, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 132, which has alpha-amylase activity.

In one embodiment is a recombinant yeast host cell comprising:

(i) a first heterologous polynucleotide encoding a polypeptide having rhamnogalacturonase activity, wherein the first heterologous polynucleotide comprises, consists, or consists essentially of the nucleotide sequence of SEQ ID NO: 55, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 55, which has rhamnogalacturonase activity;

(ii) a second heterologous polynucleotide encoding a polypeptide having pectin acetyl esterase activity, wherein the second heterologous polynucleotide comprises, consists, or consists essentially of the nucleotide sequence of SEQ ID NO: 82, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 82, which has pectin acetyl esterase activity;

(iii) a third heterologous polynucleotide encoding a polypeptide having glucoamylase activity, wherein the second heterologous polynucleotide comprises, consists, or consists essentially of the nucleotide sequence of SEQ ID NO: 131, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 131, which has glucoamylase activity; and (iv) a fourth heterologous polynucleotide encoding a polypeptide having alpha-amylase activity, wherein the second heterologous polynucleotide comprises, consists, or consists essentially of the nucleotide sequence of SEQ ID NO: 132, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 132, which has alpha-amylase activity.

In one embodiment is a recombinant yeast host cell comprising:

(i) a first heterologous polynucleotide encoding a polypeptide having rhamnogalacturonase activity, wherein the first heterologous polynucleotide comprises, consists, or consists essentially of the nucleotide sequence of SEQ ID NO: 55, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 55, which has rhamnogalacturonase activity;

(ii) a second heterologous polynucleotide encoding a polypeptide having pectin acetyl esterase activity, wherein the second heterologous polynucleotide comprises, consists, or consists essentially of the nucleotide sequence of SEQ ID NO: 85, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 85, which has pectin acetyl esterase activity;

(iii) a third heterologous polynucleotide encoding a polypeptide having glucoamylase activity, wherein the second heterologous polynucleotide comprises, consists, or consists essentially of the nucleotide sequence of SEQ ID NO: 131, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 131, which has glucoamylase activity; and (iv) a fourth heterologous polynucleotide encoding a polypeptide having alpha-amylase activity, wherein the second heterologous polynucleotide comprises, consists, or consists essentially of the nucleotide sequence of SEQ ID NO: 132, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 132, which has alpha-amylase activity.

In one embodiment is a recombinant yeast host cell comprising:

(i) a first heterologous polynucleotide encoding a polypeptide having rhamnogalacturonase activity, wherein the first heterologous polynucleotide comprises, consists, or consists essentially of the nucleotide sequence of SEQ ID NO: 58, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 58, which has rhamnogalacturonase activity;

(ii) a second heterologous polynucleotide encoding a polypeptide having pectin acetyl esterase activity, wherein the second heterologous polynucleotide comprises, consists, or consists essentially of the nucleotide sequence of SEQ ID NO: 82, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 82, which has pectin acetyl esterase activity;

(iii) a third heterologous polynucleotide encoding a polypeptide having glucoamylase activity, wherein the second heterologous polynucleotide comprises, consists, or consists essentially of the nucleotide sequence of SEQ ID NO: 131, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 131, which has glucoamylase activity; and (iv) a fourth heterologous polynucleotide encoding a polypeptide having alpha-amylase activity, wherein the second heterologous polynucleotide comprises, consists, or consists essentially of the nucleotide sequence of SEQ ID NO: 132, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 132, which has alpha-amylase activity.

In one embodiment is a recombinant yeast host cell comprising:

(i) a first heterologous polynucleotide encoding a polypeptide having rhamnogalacturonase activity, wherein the first heterologous polynucleotide comprises, consists, or consists essentially of the nucleotide sequence of SEQ ID NO: 58, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 58, which has rhamnogalacturonase activity;

(ii) a second heterologous polynucleotide encoding a polypeptide having pectin acetyl esterase activity, wherein the second heterologous polynucleotide comprises, consists, or consists essentially of the nucleotide sequence of SEQ ID NO: 85, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 85, which has pectin acetyl esterase activity;

(iii) a third heterologous polynucleotide encoding a polypeptide having glucoamylase activity, wherein the second heterologous polynucleotide comprises, consists, or consists essentially of the nucleotide sequence of SEQ ID NO: 131, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 131, which has glucoamylase activity; and (iv) a fourth heterologous polynucleotide encoding a polypeptide having alpha-amylase activity, wherein the second heterologous polynucleotide comprises, consists, or consists essentially of the nucleotide sequence of SEQ ID NO: 132, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 132, which has alpha-amylase activity.

The host cells and fermenting organisms described herein may utilize expression vectors comprising the coding sequence of one or more (e.g., two, several) heterologous genes linked to one or more control sequences that direct expression in a suitable cell under conditions compatible with the control sequence(s). Such expression vectors may be used in any of the cells and methods described herein. The polynucleotides described herein may be manipulated in a variety of ways to provide for expression of a desired polypeptide. Manipulation of the polynucleotide prior to its insertion into a vector may be desirable or necessary depending on the expression vector. The techniques for modifying polynucleotides utilizing recombinant DNA methods are well known in the art.

A construct or vector (or multiple constructs or vectors) comprising the one or more (e.g., two, several) heterologous genes may be introduced into a cell so that the construct or vector is maintained as a chromosomal integrant or as a self-replicating extra-chromosomal vector as described earlier.

The various nucleotide and control sequences may be joined together to produce a recombinant expression vector that may include one or more (e.g., two, several) convenient restriction sites to allow for insertion or substitution of the polynucleotide at such sites. Alternatively, the polynucleotide(s) may be expressed by inserting the polynucleotide(s) or a nucleic acid construct comprising the sequence into an appropriate vector for expression. In creating the expression vector, the coding sequence is located in the vector so that the coding sequence is operably linked with the appropriate control sequences for expression.

The recombinant expression vector may be any vector (e.g., a plasmid or virus) that can be conveniently subjected to recombinant DNA procedures and can bring about expression of the polynucleotide. The choice of the vector will typically depend on the compatibility of the vector with the host cell into which the vector is to be introduced. The vector may be a linear or closed circular plasmid.

The vector may be an autonomously replicating vector, i.e., a vector that exists as an extrachromosomal entity, the replication of which is independent of chromosomal replication, e.g., a plasmid, an extrachromosomal element, a minichromosome, or an artificial chromosome. The vector may contain any means for assuring self-replication. Alternatively, the vector may be one that, when introduced into the host cell, is integrated into the genome and replicated together with the chromosome(s) into which it has been integrated. Furthermore, a single vector or plasmid or two or more vectors or plasmids that together contain the total DNA to be introduced into the genome of the cell, or a transposon, may be used.

The expression vector may contain any suitable promoter sequence that is recognized by a cell for expression of a gene described herein. The promoter sequence contains transcriptional control sequences that mediate the expression of the polypeptide. The promoter may be any polynucleotide that shows transcriptional activity in the cell of choice including mutant, truncated, and hybrid promoters, and may be obtained from genes encoding extracellular or intracellular polypeptides either homologous or heterologous to the cell.

Each heterologous polynucleotide described herein may be operably linked to a promoter that is foreign to the polynucleotide. For example, in one embodiment, the nucleic acid construct encoding the fusion protein is operably linked to a promoter foreign to the polynucleotide. The promoters may be identical to or share a high degree of sequence identity (e.g., at least about 80%, at least about 85%, at least about 90%, at least about 95%, at least about 96%, at least about 97%, at least about 98%, or at least about 99%) with a selected native promoter.

Examples of suitable promoters for directing the transcription of the nucleic acid constructs in a yeast cells, include, but are not limited to, the promoters obtained from the genes for enolase, (e.g., *S. cerevisiae* enolase or *I. orientalis* enolase (ENO1)), galactokinase (e.g., *S. cerevisiae* galactokinase or *I. orientalis* galactokinase (GAL1)), alcohol dehydrogenase/glyceraldehyde-3 phosphate dehydrogenase (e.g., *S. cerevisiae* alcohol dehydrogenase/glyceraldehyde-3 phosphate dehydrogenase or *I. orientalis* alcohol dehydrogenase/glyceraldehyde-3 phosphate dehydrogenase (ADH1, ADH2/GAP)), triose phosphate isomerase (e.g., *S. cerevisiae* triose phosphate isomerase or *I. orientalis* triose phosphate isomerase (TPI)), metallothionein (e.g., *S. cerevisiae* metallothionein or *I. orientalis* metallothionein (CUP1)), 3-phosphoglycerate kinase (e.g., *S. cerevisiae* 3 phosphoglycerate kinase or *I. orientalis* 3-phosphoglycerate kinase (PGK)), PDC1, xylose reductase (XR), xylitol dehydrogenase (XDH), L-(+)-lactate-cytochrome c oxidoreductase (CYB2), translation elongation factor-1 (TEF1), translation elongation factor-2 (TEF2), glyceraldehyde-3-phosphate dehydrogenase (GAPDH), and orotidine 5'-phosphate decarboxylase (URA3) genes. Other suitable promoters may be obtained from *S. cerevisiae* TDH3, HXT7, PGK1, RPL18B and CCW12 genes. Additional useful promoters for yeast host cells are described by Romanos et al., 1992, Yeast 8: 423-488.

The control sequence may also be a suitable transcription terminator sequence, which is recognized by a host cell to terminate transcription. The terminator sequence is operably linked to the 3'-terminus of the polynucleotide encoding the polypeptide. Any terminator that is functional in the yeast cell of choice may be used. The terminator may be identical to or share a high degree of sequence identity (e.g., at least about 80%, at least about 85%, at least about 90%, at least about 95%, at least about 96%, at least about 97%, at least about 98%, or at least about 99%) with the selected native terminator.

Suitable terminators for yeast host cells may be obtained from the genes for enolase (e.g., *S. cerevisiae* or *I. orientalis* enolase cytochrome C (e.g., *S. cerevisiae* or *I. orientalis* cytochrome (CYC1)), glyceraldehyde-3 phosphate dehydrogenase (e.g., *S. cerevisiae* or *I. orientalis* glyceraldehyde-3-phosphate dehydrogenase (gpd)), PDC1, XR, XDH, transaldolase (TAL), transketolase (TKL), ribose 5-phosphate ketol-isomerase (RKI), CYB2, and the galactose family of genes (especially the GAL10 terminator). Other suitable terminators may be obtained from *S. cerevisiae* ENO2 or TEF1 genes. Additional useful terminators for yeast host cells are described by Romanos et al., 1992, supra.

The control sequence may also be an mRNA stabilizer region downstream of a promoter and upstream of the coding sequence of a gene which increases expression of the gene.

Examples of suitable mRNA stabilizer regions are obtained from a *Bacillus thuringiensis* cryIIIA gene (WO 94/25612) and a *Bacillus subtilis* SP82 gene (Hue et al., 1995, Journal of Bacteriology 177: 3465-3471).

The control sequence may also be a suitable leader sequence, when transcribed is a nontranslated region of an mRNA that is important for translation by the host cell. The leader sequence is operably linked to the 5'-terminus of the polynucleotide encoding the polypeptide. Any leader sequence that is functional in the yeast cell of choice may be used.

Suitable leaders for yeast host cells are obtained from the genes for enolase (e.g., *S. cerevisiae* or *I. orientalis* enolase (ENO-1)), 3-phosphoglycerate kinase (e.g., *S. cerevisiae* or *I. orientalis* 3-phosphoglycerate kinase), alpha-factor (e.g., *S. cerevisiae* or *I. orientalis* alpha-factor), and alcohol dehydrogenase/glyceraldehyde-3-phosphate dehydrogenase (e.g., *S. cerevisiae* or *I. orientalis* alcohol dehydrogenase/glyceraldehyde-3 phosphate dehydrogenase (ADH2/GAP)).

The control sequence may also be a polyadenylation sequence; a sequence operably linked to the 3'-terminus of the polynucleotide and, when transcribed, is recognized by the host cell as a signal to add polyadenosine residues to transcribed mRNA. Any polyadenylation sequence that is functional in the host cell of choice may be used. Useful polyadenylation sequences for yeast cells are described by Guo and Sherman, 1995, Mol. Cellular Biol. 15: 5983-5990.

The control sequence may also be a signal peptide coding region that encodes a signal peptide linked to the N-terminus of a polypeptide and directs the polypeptide into the cell's secretory pathway. The 5'-end of the coding sequence of the polynucleotide may inherently contain a signal peptide coding sequence naturally linked in translation reading frame with the segment of the coding sequence that encodes the polypeptide. Alternatively, the 5' end of the coding sequence may contain a signal peptide coding sequence that is foreign to the coding sequence. A foreign signal peptide coding sequence may be required where the coding sequence does not naturally contain a signal peptide coding sequence. Alternatively, a foreign signal peptide coding sequence may simply replace the natural signal peptide coding sequence in order to enhance secretion of the polypeptide. However, any signal peptide coding sequence that directs the expressed polypeptide into the secretory pathway of a host cell may be used. Useful signal peptides for yeast host cells are obtained from the genes for *Saccharomyces cerevisiae* alpha-factor and *Saccharomyces cerevisiae* invertase. Other useful signal peptide coding sequences are described by Romanos et al., 1992, supra.

The control sequence may also be a propeptide coding sequence that encodes a propeptide positioned at the N-terminus of a polypeptide. The resultant polypeptide is known as a proenzyme or propolypeptide (or a zymogen in some cases). A propolypeptide is generally inactive and can be converted to an active polypeptide by catalytic or autocatalytic cleavage of the propeptide from the propolypeptide. The propeptide coding sequence may be obtained from the genes for *Bacillus subtilis* alkaline protease (aprE), *Bacillus subtilis* neutral protease (nprT), *Myceliophthora thermophila* laccase (WO 95/33836), *Rhizomucor miehei* aspartic proteinase, and *Saccharomyces cerevisiae* alpha-factor.

Where both signal peptide and propeptide sequences are present, the propeptide sequence is positioned next to the N-terminus of a polypeptide and the signal peptide sequence is positioned next to the N-terminus of the propeptide sequence.

It may also be desirable to add regulatory sequences that allow the regulation of the expression of the polypeptide relative to the growth of the host cell. Examples of regulatory systems are those that cause the expression of the gene to be turned on or off in response to a chemical or physical stimulus, including the presence of a regulatory compound. Regulatory systems in prokaryotic systems include the lac, tac, and trp operator systems. In yeast, the ADH2 system or GAL1 system may be used.

The vectors may contain one or more (e.g., two, several) selectable markers that permit easy selection of transformed, transfected, transduced, or the like cells. A selectable marker is a gene the product of which provides for biocide or viral resistance, resistance to heavy metals, prototrophy to auxotrophs, and the like. Suitable markers for yeast host cells include, but are not limited to, ADE2, HIS3, LEU2, LYS2, MET3, TRP1, and URA3.

The vectors may contain one or more (e.g., two, several) elements that permit integration of the vector into the host cell's genome or autonomous replication of the vector in the cell independent of the genome.

For integration into the host cell genome, the vector may rely on the polynucleotide's sequence encoding the polypeptide or any other element of the vector for integration into the genome by homologous or non-homologous recombination. Alternatively, the vector may contain additional polynucleotides for directing integration by homologous recombination into the genome of the host cell at a precise location(s) in the chromosome(s). To increase the likelihood of integration at a precise location, the integrational elements should contain a sufficient number of nucleic acids, such as 100 to 10,000 base pairs, 400 to 10,000 base pairs, and 800 to 10,000 base pairs, which have a high degree of sequence identity to the corresponding target sequence to enhance the probability of homologous recombination. The integrational elements may be any sequence that is homologous with the target sequence in the genome of the host cell. Furthermore, the integrational elements may be non-encoding or encoding polynucleotides. On the other hand, the vector may be integrated into the genome of the host cell by non-homologous recombination. Potential integration loci include those described in the art (e.g., See US2012/0135481).

For autonomous replication, the vector may further comprise an origin of replication enabling the vector to replicate autonomously in the yeast cell. The origin of replication may be any plasmid replicator mediating autonomous replication that functions in a cell. The term "origin of replication" or "plasmid replicator" means a polynucleotide that enables a plasmid or vector to replicate in vivo. Examples of origins of replication for use in a yeast host cell are the 2 micron origin of replication, ARS1, ARS4, the combination of ARS1 and CEN3, and the combination of ARS4 and CEN6.

More than one copy of a polynucleotide described herein may be inserted into a host cell to increase production of a polypeptide. An increase in the copy number of the polynucleotide can be obtained by integrating at least one additional copy of the sequence into the yeast cell genome or by including an amplifiable selectable marker gene with the polynucleotide where cells containing amplified copies of the selectable marker gene, and thereby additional copies of the polynucleotide, can be selected for by cultivating the cells in the presence of the appropriate selectable agent.

The procedures used to ligate the elements described above to construct the recombinant expression vectors described herein are well known to one skilled in the art (see, e.g., Sambrook et al., 1989, Molecular Cloning, A Laboratory Manual, 2d edition, Cold Spring Harbor, New York).

Additional procedures and techniques known in the art for the preparation of recombinant cells for ethanol fermentation, are described in, e.g., WO 2016/045569, the content of which is hereby incorporated by reference.

The host cell or fermenting organism may be in the form of a composition comprising a host cell or fermenting organism (e.g., a yeast strain described herein) and a naturally occurring and/or a non-naturally occurring component.

The host cell or fermenting organism described herein may be in any viable form, including crumbled, dry, including active dry and instant, compressed, cream (liquid) form etc. In one embodiment, the host cell or fermenting organism (e.g., a *Saccharomyces cerevisiae* yeast strain) is dry yeast, such as active dry yeast or instant yeast. In one embodiment, the host cell or fermenting organism (e.g., a *Saccharomyces cerevisiae* yeast strain) is crumbled yeast. In one embodiment, the host cell or fermenting organism (e.g., a *Saccharomyces cerevisiae* yeast strain) is compressed yeast. In one embodiment, the host cell or fermenting organism (e.g., a *Saccharomyces cerevisiae* yeast strain) is cream yeast.

In one embodiment is a composition comprising a host cell or fermenting organism described herein (e.g., a *Saccharomyces cerevisiae* yeast strain), and one or more of the component selected from the group consisting of: surfactants, emulsifiers, gums, swelling agent, and antioxidants and other processing aids.

The compositions described herein may comprise a host cell or fermenting organism described herein (e.g., a *Saccharomyces cerevisiae* yeast strain) and any suitable surfactants. In one embodiment, the surfactant(s) is/are an anionic surfactant, cationic surfactant, and/or nonionic surfactant.

The compositions described herein may comprise a host cell or fermenting organism described herein (e.g., a *Saccharomyces cerevisiae* yeast strain) and any suitable emulsifier. In one embodiment, the emulsifier is a fatty-acid ester of sorbitan. In one embodiment, the emulsifier is selected from the group of sorbitan monostearate (SMS), citric acid esters of monodiglycerides, polyglycerolester, fatty acid esters of propylene glycol.

In one embodiment, the composition comprises a host cell or fermenting organism described herein (e.g., a *Saccharomyces cerevisiae* yeast strain), and Olindronal SMS, Olindronal SK, or Olindronal SPL including composition concerned in European Patent No. 1,724,336 (hereby incorporated by reference). These products are commercially available from Bussetti, Austria, for active dry yeast.

The compositions described herein may comprise a host cell or fermenting organism described herein (e.g., a *Saccharomyces cerevisiae* yeast strain) and any suitable gum. In one embodiment, the gum is selected from the group of carob, guar, tragacanth, arabic, xanthan and acacia gum, in particular for cream, compressed and dry yeast.

The compositions described herein may comprise a host cell or fermenting organism described herein (e.g., a *Saccharomyces cerevisiae* yeast strain) and any suitable swelling agent. In one embodiment, the swelling agent is methyl cellulose or carboxymethyl cellulose.

The compositions described herein may comprise a host cell or fermenting organism described herein (e.g., a *Saccharomyces cerevisiae* yeast strain) and any suitable antioxidant. In one embodiment, the antioxidant is butylated hydroxyanisol (BHA) and/or butylated hydroxytoluene (BHT), or ascorbic acid (vitamin C), particular for active dry yeast.

The host cells and fermenting organisms described herein may also comprise one or more (e.g., two, several) gene disruptions, e.g., to divert sugar metabolism from undesired products to ethanol. In some embodiments, the recombinant host cells produce a greater amount of ethanol compared to the cell without the one or more disruptions when cultivated under identical conditions. In some embodiments, one or more of the disrupted endogenous genes is inactivated.

In certain embodiments, the host cell or fermenting organism provided herein comprises a disruption of one or more endogenous genes encoding enzymes involved in producing alternate fermentative products such as glycerol or other byproducts such as acetate or diols. For example, the cells provided herein may comprise a disruption of one or more of glycerol 3-phosphate dehydrogenase (GPD, catalyzes reaction of dihydroxyacetone phosphate to glycerol 3-phosphate), glycerol 3-phosphatase (GPP, catalyzes conversion of glycerol-3 phosphate to glycerol), glycerol kinase (catalyzes conversion of glycerol 3-phosphate to glycerol), dihydroxyacetone kinase (catalyzes conversion of dihydroxyacetone phosphate to dihydroxyacetone), glycerol dehydrogenase (catalyzes conversion of dihydroxyacetone to glycerol), and aldehyde dehydrogenase (ALD, e.g., converts acetaldehyde to acetate).

Modeling analysis can be used to design gene disruptions that additionally optimize utilization of the pathway. One exemplary computational method for identifying and designing metabolic alterations favoring biosynthesis of a desired product is the OptKnock computational framework, Burgard et al., 2003, Biotechnol. Bioeng. 84: 647-657.

The host cells and fermenting organisms comprising a gene disruption may be constructed using methods well known in the art, including those methods described herein. A portion of the gene can be disrupted such as the coding region or a control sequence required for expression of the coding region. Such a control sequence of the gene may be a promoter sequence or a functional part thereof, i.e., a part that is sufficient for affecting expression of the gene. For example, a promoter sequence may be inactivated resulting in no expression or a weaker promoter may be substituted for the native promoter sequence to reduce expression of the coding sequence. Other control sequences for possible modification include, but are not limited to, a leader, propeptide sequence, signal sequence, transcription terminator, and transcriptional activator.

The host cells and fermenting organisms comprising a gene disruption may be constructed by gene deletion techniques to eliminate or reduce expression of the gene. Gene deletion techniques enable the partial or complete removal of the gene thereby eliminating their expression. In such methods, deletion of the gene is accomplished by homologous recombination using a plasmid that has been constructed to contiguously contain the 5' and 3' regions flanking the gene.

The host cells and fermenting organisms comprising a gene disruption may also be constructed by introducing, substituting, and/or removing one or more (e.g., two, several) nucleotides in the gene or a control sequence thereof required for the transcription or translation thereof. For example, nucleotides may be inserted or removed for the introduction of a stop codon, the removal of the start codon, or a frame-shift of the open reading frame. Such a modification may be accomplished by site-directed mutagenesis or PCR generated mutagenesis in accordance with methods known in the art. See, for example, Botstein and Shortle, 1985, Science 229: 4719; Lo et al., 1985, Proc. Natl. Acad. Sci. U.S.A. 81: 2285; Higuchi et al., 1988, Nucleic Acids Res 16: 7351; Shimada, 1996, Meth. Mol. Biol. 57: 157; Ho et al., 1989, Gene 77: 61; Horton et al., 1989, Gene 77: 61; and Sarkar and Sommer, 1990, BioTechniques 8: 404.

The host cells and fermenting organisms comprising a gene disruption may also be constructed by inserting into the gene a disruptive nucleic acid construct comprising a nucleic acid fragment homologous to the gene that will create a duplication of the region of homology and incorporate construct DNA between the duplicated regions. Such a gene disruption can eliminate gene expression if the inserted construct separates the promoter of the gene from the coding region or interrupts the coding sequence such that a non-functional gene product results. A disrupting construct may be simply a selectable marker gene accompanied by 5' and 3' regions homologous to the gene. The selectable marker enables identification of transformants containing the disrupted gene.

The host cells and fermenting organisms comprising a gene disruption may also be constructed by the process of gene conversion (see, for example, Iglesias and Trautner, 1983, Molecular General Genetics 189: 73-76). For example, in the gene conversion method, a nucleotide sequence corresponding to the gene is mutagenized in vitro to produce a defective nucleotide sequence, which is then transformed into the recombinant strain to produce a defective gene. By homologous recombination, the defective nucleotide sequence replaces the endogenous gene. It may be desirable that the defective nucleotide sequence also comprises a marker for selection of transformants containing the defective gene.

The host cells and fermenting organisms comprising a gene disruption may be further constructed by random or specific mutagenesis using methods well known in the art, including, but not limited to, chemical mutagenesis (see, for example, Hopwood, The Isolation of Mutants in Methods in Microbiology (J. R. Norris and D. W. Ribbons, eds.) pp. 363-433, Academic Press, New York, 1970). Modification of the gene may be performed by subjecting the parent strain to mutagenesis and screening for mutant strains in which expression of the gene has been reduced or inactivated. The mutagenesis, which may be specific or random, may be performed, for example, by use of a suitable physical or chemical mutagenizing agent, use of a suitable oligonucleotide, or subjecting the DNA sequence to PCR generated mutagenesis. Furthermore, the mutagenesis may be performed by use of any combination of these mutagenizing methods.

Examples of a physical or chemical mutagenizing agent suitable for the present purpose include ultraviolet (UV) irradiation, hydroxylamine, N-methyl-N'-nitro-N-nitrosoguanidine (MNNG), N-methyl-N'-nitrosogaunidine (NTG) O-methyl hydroxylamine, nitrous acid, ethyl methane sulphonate (EMS), sodium bisulphite, formic acid, and nucleotide analogues. When such agents are used, the mutagenesis is typically performed by incubating the parent strain to be mutagenized in the presence of the mutagenizing agent of choice under suitable conditions, and selecting for mutants exhibiting reduced or no expression of the gene.

A nucleotide sequence homologous or complementary to a gene described herein may be used from other microbial sources to disrupt the corresponding gene in a recombinant strain of choice.

In one embodiment, the modification of a gene in the recombinant cell is unmarked with a selectable marker. Removal of the selectable marker gene may be accomplished by culturing the mutants on a counter-selection medium. Where the selectable marker gene contains repeats flanking its 5 and 3' ends, the repeats will facilitate the looping out of the selectable marker gene by homologous recombination when the mutant strain is submitted to counter-selection. The selectable marker gene may also be removed by homologous recombination by introducing into the mutant strain a nucleic acid fragment comprising 5' and 3' regions of the defective gene, but lacking the selectable marker gene, followed by selecting on the counter-selection medium. By homologous recombination, the defective gene containing the selectable marker gene is replaced with the nucleic acid fragment lacking the selectable marker gene. Other methods known in the art may also be used.

Starch-Containing Materials

Any suitable starch-containing material may be used according to the present invention. The starting material is generally selected based on the desired fermentation product. Examples of starch-containing materials, suitable for use in a process of the invention, include whole grains, corn, wheat, barley, rye, milo, sago, cassava, tapioca, sorghum, rice, peas, beans, or sweet potatoes, or mixtures thereof or starches derived there from, or cereals. Contemplated are also waxy and non-waxy types of corn and barley. In a preferred embodiment the starch-containing material, used for ethanol production according to the invention, is corn or wheat.

Fermentation Products

The term “fermentation product” means a product produced by a process including a fermentation step using a fermenting organism. A fermentation product can be any substance derived from the fermentation. The fermentation product can be, without limitation, an alcohol (e.g., arabinitol, n-butanol, isobutanol, ethanol, glycerol, methanol, ethylene glycol, 1,3-propanediol [propylene glycol], butanediol, glycerin, sorbitol, and xylitol); an (e.g., pentane, hexane, heptane, octane, nonane, decane, undecane, and dodecane), a cycloalkane (e.g., cyclopentane, cyclohexane, cycloheptane, and cyclooctane), an alkene (e.g., pentene, hexene, heptene, and octene); an amino acid (e.g., aspartic acid, glutamic acid, glycine, lysine, serine, and threonine); a gas (e.g., methane, hydrogen ($H_2$), carbon dioxide ($CO_2$), and carbon monoxide (CO)); isoprene; a ketone (e.g., acetone); an organic acid (e.g., acetic acid, acetonic acid, adipic acid, ascorbic acid, citric acid, 2,5-diketo-D-gluconic acid, formic acid, fumaric acid, glucaric acid, gluconic acid, glucuronic acid, glutaric acid, 3-hydroxypropionic acid, itaconic acid, lactic acid, malic acid, malonic acid, oxalic acid, oxaloacetic acid, propionic acid, succinic acid, and xylonic acid); and polyketide.

In one embodiment, the fermentation product is an alcohol. The term “alcohol” encompasses a substance that contains one or more hydroxyl moieties. The alcohol can be, but is not limited to, n-butanol, isobutanol, ethanol, methanol, arabinitol, butanediol, ethylene glycol, glycerin, glycerol, 1,3-propanediol, sorbitol, xylitol. See, for example, Gong et al., 1999, Ethanol production from renewable resources, in *Advances in Biochemical Engineering/Biotechnology*, Scheper, T., ed., Springer-Verlag Berlin Heidelberg, Germany, 65: 207-241; Silveira and Jonas, 2002, *Appl. Microbiol. Biotechnol.* 59: 400-408; Nigam and Singh, 1995, *Process Biochemistry* 30(2): 117-124; Ezeji et al., 2003, *World Journal of Microbiology and Biotechnology* 19(6): 595-603. In one embodiment, the fermentation product is ethanol.

In another embodiment, the fermentation product is an alkane. The alkane may be an unbranched or a branched alkane. The alkane can be, but is not limited to, pentane, hexane, heptane, octane, nonane, decane, undecane, or dodecane. In another embodiment, the fermentation product is a cycloalkane. The cycloalkane can be, but is not limited to, cyclopentane, cyclohexane, cycloheptane, or cyclooctane. In another aspect, the fermentation product is an alkene. The alkene may be an unbranched or a branched alkene. The alkalkaneene can be, but is not limited to, pentene, hexene, heptene, or octene.

In another aspect, the fermentation product is an amino acid. The amino acid can be, but is not limited to, aspartic acid, glutamic acid, glycine, lysine, serine, or threonine. See, for example, Richard and Margaritis, 2004, *Biotechnology and Bioengineering* 87(4): 501-515.

In another embodiment, the fermentation product is a gas. The gas can be, but is not limited to, methane, $H_2$, $CO_2$, or CO. See, for example, Kataoka et al., 1997, *Water Science and Technology* 36(6-7): 41-47; and Gunaseelan, 1997, *Biomass and Bioenergy* 13(1-2): 83-114.

In another embodiment, the fermentation product is antibiotics (e.g., penicillin and tetracycline).

In another embodiment, the fermentation product is isoprene.

In another embodiment, the fermentation product is an enzyme.

In another embodiment, the fermentation product is a hormone.

In another embodiment, the fermentation product is a ketone. The term “ketone” encompasses a substance that contains one or more ketone moieties. The ketone can be, but is not limited to, acetone.

In another embodiment, the fermentation product is an organic acid. The organic acid can be, but is not limited to, acetic acid, acetonic acid, adipic acid, ascorbic acid, citric acid, 2,5-diketo-D-gluconic acid, formic acid, fumaric acid, glucaric acid, gluconic acid, glucuronic acid, glutaric acid, 3-hydroxypropionic acid, itaconic acid, lactic acid, malic acid, malonic acid, oxalic acid, propionic acid, succinic acid, or xylonic acid. See, for example, Chen and Lee, 1997, *Appl. Biochem. Biotechnol.* 63-65: 435-448.

In another embodiment, the fermentation product is polyketide.

In a preferred embodiment the fermentation product is ethanol, e.g., fuel ethanol; drinking ethanol, i.e., potable neutral spirits; or industrial ethanol or products used in the consumable alcohol industry (e.g., beer and wine), dairy industry (e.g., fermented dairy products), leather industry and tobacco industry. Preferred beer types comprise ales, stouts, porters, lagers, bitters, malt liquors, happoushu, high-alcohol beer, low-alcohol beer, low-calorie beer or light beer. Preferably processes of the invention are used for producing an alcohol, such as ethanol. The fermentation product, such as ethanol, obtained according to the invention, may be used as fuel, which is typically blended with gasoline. However, in the case of ethanol it may also be used as potable ethanol.

Recovery

The fermentation product, e.g., ethanol, can optionally be recovered from the fermentation medium using any method known in the art including, but not limited to, chromatography, electrophoretic procedures, differential solubility, distillation, or extraction. For example, alcohol is separated from the fermented cellulosic material or fermented starch-containing material and purified by conventional methods of distillation. As another example, the desired fermentation product may be extracted from the fermentation medium by micro or membrane filtration techniques. Ethanol with a purity of up to about 96 vol. % can be obtained, which can be used as, for example, fuel ethanol, drinking ethanol, i.e., potable neutral spirits, or industrial ethanol.

In some embodiments of the methods, the fermentation product after being recovered is substantially pure. With respect to the methods herein, "substantially pure" intends a recovered preparation that contains no more than 15% impurity, wherein impurity intends compounds other than the fermentation product (e.g., ethanol). In one variation, a substantially pure preparation is provided wherein the preparation contains no more than 25% impurity, or no more than 20% impurity, or no more than 10% impurity, or no more than 5% impurity, or no more than 3% impurity, or no more than 1% impurity, or no more than 0.5% impurity.

Suitable assays to test for the production of ethanol and contaminants, and sugar consumption can be performed using methods known in the art. For example, ethanol product, as well as other organic compounds, can be analyzed by methods such as HPLC (High Performance Liquid Chromatography), GC-MS (Gas Chromatography Mass Spectroscopy) and LC-MS (Liquid Chromatography-Mass Spectroscopy) or other suitable analytical methods using routine procedures well known in the art. The release of ethanol in the fermentation broth can also be tested with the culture supernatant. Byproducts and residual sugar in the fermentation medium (e.g., glucose orxylose) can be quantified by HPLC using, for example, a refractive index detector for glucose and alcohols, and a UV detector for organic acids (Lin et al., *Biotechnol. Bioeng.* 90:775-779 (2005)), or using other suitable assay and detection methods well known in the art.

Alpha-Amylase Present and/or Added During Liquefaction

According to the invention an alpha-amylase is present and/or added during liquefaction together with an optional thermostable protease, optional carbohydrate-source generating enzyme, in particular a thermostable glucoamylase, and/or optional pullulanase.

The alpha-amylase added during liquefaction step i) may be any alpha-amylase. Preferred are bacterial alpha-amylases, which typically are stable at temperature used during liquefaction.

Any alpha-amylase herein contemplated as being present and/or added during liquefaction is also contemplated for expression by a fermenting organism or host cell.

The term "bacterial alpha-amylase" means any bacterial alpha-amylase classified under EC 3.2.1.1. A bacterial alpha-amylase used according to the invention may, e.g., be derived from a strain of the genus *Bacillus*, which is sometimes also referred to as the genus *Geobacillus*. In an embodiment the *Bacillus* alpha-amylase is derived from a strain of *Bacillus amyloliquefaciens, Bacillus licheniformis, Bacillus stearothermophilus*, or *Bacillus subtilis*, but may also be derived from other *Bacillus* sp.

Specific examples of bacterial alpha-amylases include the *Bacillus stearothermophilus* alpha-amylase of SEQ ID NO: 3 in WO 99/19467, the *Bacillus amyloliquefaciens* alpha-amylase of SEQ ID NO: 5 in WO 99/19467, and the *Bacillus licheniformis* alpha-amylase of SEQ ID NO: 4 in WO 99/19467 (all sequences are hereby incorporated by reference). In an embodiment the alpha-amylase may be an enzyme having a degree of identity of at least 60%, e.g., at least 70%, at least 80%, at least 90%, at least 95%, at least 96%, at least 97%, at least 98% or at least 99% to any of the sequences shown in SEQ ID NOS: 3, 4 or 5, respectively, in WO 99/19467.

In an embodiment the alpha-amylase may be an enzyme having a degree of identity of at least 60%, e.g., at least 70%, at least 80%, at least 90%, at least 91%, at least 92%, at least 93%, at least 94%, at least 95%, at least 96%, at least 97%, at least 98% or at least 99% to any of the sequences shown in SEQ ID NO: 3 in WO 99/19467 or SEQ ID NO: 30 herein.

In a preferred embodiment the alpha-amylase is derived from *Bacillus stearothermophilus*. The *Bacillus stearothermophilus* alpha-amylase may be a mature wild-type or a mature variant thereof. The mature *Bacillus stearothermophilus* alpha-amylases may naturally be truncated during recombinant production. For instance, the *Bacillus stearothermophilus* alpha-amylase may be a truncated so it has around 491 amino acids compared to SEQ ID NO: 3 in WO 99/19467.

The *Bacillus* alpha-amylase may also be a variant and/or hybrid. Examples of such a variant can be found in any of WO 96/23873, WO 96/23874, WO 97/41213, WO 99/19467, WO 00/60059, and WO 02/10355 (all documents are hereby incorporated by reference). Specific alpha-amylase variants are disclosed in U.S. Pat. Nos. 6,093,562, 6,187,576, 6,297,038, and 7,713,723 (hereby incorporated by reference) and include *Bacillus stearothermophilus* alpha-amylase (often referred to as BSG alpha-amylase) variants having a deletion of one or two amino acids at positions R179, G180, I181 and/or G182, preferably a double deletion disclosed in WO 96/23873—see, e.g., page 20, lines 1-10 (hereby incorporated by reference), preferably corresponding to deletion of positions I181 and G182 compared to the amino acid sequence of *Bacillus stearothermophilus* alpha-amylase set forth in SEQ ID NO: 3 disclosed in WO 99/19467 or SEQ ID NO: 114 herein or the deletion of amino acids R179 and G180 using SEQ ID NO: 3 in WO 99/19467 or SEQ ID NO: 30 herein for numbering (which reference is hereby incorporated by reference). Even more preferred are *Bacillus* alpha-amylases, especially *Bacillus stearothermophilus* alpha-amylases, which have a double deletion corresponding to a deletion of positions 181 and 182 and further comprise a N193F substitution (also denoted I181*+G182*+N193F) compared to the wild-type BSG alpha-amylase amino acid sequence set forth in SEQ ID NO: 3 disclosed in WO 99/19467 or SEQ ID NO: 114 herein. The bacterial alpha-amylase may also have a substitution in a position corresponding to S239 in the *Bacillus licheniformis* alpha-amylase shown in SEQ ID NO: 4 in WO 99/19467, or a S242 variant of the *Bacillus stearothermophilus* alpha-amylase of SEQ ID NO: 3 in WO 99/19467 or SEQ ID NO: 114 herein.

In an embodiment the variant is a S242A, E or Q variant, preferably a S242Q variant, of the *Bacillus stearothermophilus* alpha-amylase (using SEQ ID NO: 114 herein for numbering).

In an embodiment the variant is a position E188 variant, preferably E188P variant of the *Bacillus stearothermophilus* alpha-amylase (using SEQ ID NO: 114 herein for numbering).

The bacterial alpha-amylase may in an embodiment be a truncated alpha-amylase. Especially the truncation is so that the *Bacillus stearothermophilus* alpha-amylase shown in SEQ ID NO: 3 in WO 99/19467 or SEQ ID NO: 114 herein, is around 491 amino acids long, such as from 480 to 495 amino acids long.

Most importantly, a suitable alpha-amylase for use in liquefaction must have sufficient thermo-stability, and thus accordingly any alpha-amylase having a T½ (min) at pH 4.5, 85° C., 0.12 mM $CaCl_2$) of at least 10, such as at least 15, such as at least 20, such as at least 25, such as at least 30, such as at least 40, such as at least 50, such as at least 60, such as between 10-70, such as between 15-70, such as between 20-70, such as between 25-70, such as between 30-70, such as between 40-70, such as between 50-70, such as between 60-70, may be used.

According to the invention the alpha-amylase may be a thermostable alpha-amylase, such as a thermostable bacterial alpha-amylase, preferably from *Bacillus stearothermophilus*. In an embodiment the alpha-amylase used according to the invention has a T½ (min) at pH 4.5, 85° C., 0.12 mM $CaCl_2$ of at least 10.

In an embodiment the thermostable alpha-amylase has a T½ (min) at pH 4.5, 85° C., 0.12 mM $CaCl_2$, of at least 15.

In an embodiment the thermostable alpha-amylase has a T½ (min) at pH 4.5, 85° C., 0.12 mM $CaCl_2$, of as at least 20.

In an embodiment the thermostable alpha-amylase has a T½ (min) at pH 4.5, 85° C., 0.12 mM $CaCl_2$, of as at least 25.

In an embodiment the thermostable alpha-amylase has a T½ (min) at pH 4.5, 85° C., 0.12 mM $CaCl_2$, of as at least 30.

In an embodiment the thermostable alpha-amylase has a T½ (min) at pH 4.5, 85° C., 0.12 mM $CaCl_2$, of as at least 40.

In an embodiment the thermostable alpha-amylase has a T½ (min) at pH 4.5, 85° C., 0.12 mM $CaCl_2$, of at least 50.

In an embodiment the thermostable alpha-amylase has a T½ (min) at pH 4.5, 85° C., 0.12 mM $CaCl_2$, of at least 60.

In an embodiment the thermostable alpha-amylase has a T½ (min) at pH 4.5, 85° C., 0.12 mM $CaCl_2$, between 10-70.

In an embodiment the thermostable alpha-amylase has a T½ (min) at pH 4.5, 85° C., 0.12 mM $CaCl_2$, between 15-70.

In an embodiment the thermostable alpha-amylase has a T½ (min) at pH 4.5, 85° C., 0.12 mM $CaCl_2$, between 20-70.

In an embodiment the thermostable alpha-amylase has a T½ (min) at pH 4.5, 85° C., 0.12 mM $CaCl_2$, between 25-70.

In an embodiment the thermostable alpha-amylase has a T½ (min) at pH 4.5, 85° C., 0.12 mM $CaCl_2$, between 30-70.

In an embodiment the thermostable alpha-amylase has a T½ (min) at pH 4.5, 85° C., 0.12 mM $CaCl_2$, between 40-70.

In an embodiment the thermostable alpha-amylase has a T½ (min) at pH 4.5, 85° C., 0.12 mM $CaCl_2$, between 50-70.

In an embodiment the thermostable alpha-amylase has a T½ (min) at pH 4.5, 85° C., 0.12 mM $CaCl_2$, between 60-70.

In an embodiment of the invention the alpha-amylase is an bacterial alpha-amylase, preferably derived from the genus *Bacillus*, especially a strain of *Bacillus stearothermophilus*, in particular the *Bacillus stearothermophilus* as disclosed in WO 99/019467 as SEQ ID NO: 3 (SEQ ID NO: 114 herein) with one or two amino acids deleted at positions R179, G180, I181 and/or G182, in particular with R179 and G180 deleted, or with I181 and G182 deleted, with mutations in below list of mutations.

In preferred embodiments the *Bacillus stearothermophilus* alpha-amylases have double deletion I181+G182, and optional substitution N193F, further comprising mutations selected from below list.

In a preferred embodiment the alpha-amylase is selected from the following group of *Bacillus stearothermophilus* alpha-amylase variants (using SEQ ID NO: 114 for numbering):

I181*+G182*+N193F+E129V+K177L+R179E;

I181*+G182*+N193F+E129V+K177L+R179S;

I181*+G182*+N193F+V59A+Q89R+E129V+K177L+R179E+H208Y+K220P+N224L+Q254S

I181*+G182*+N193F+V59A+Q89R+E129V+K177L+R179E+Q254S+M284V;

I181*+G182*+N193F+V59A+Q89R+E129V+K177L+R179S+Q254S+M284V;

I181*+G182*+N193F+V59A+E129V+K177L+R179E+Q254S+M284V;

I181*+G182*+N193F+V59A+E129V+K177L+R179S+Q254S+M284V;

I181*+G182*+N193F+E129V+K177L+R179E+K220P+N224L+S242Q+Q254S;

I181*+G182*+N193F+E129V+K177L+R179S+K220P+N224L+S242Q+Q254S;

I181*+G182*+V59A+E129V+K177L+R179E+Q254S+M284V+V212T+Y268G+N293Y+T297N;

I181*+G182*+V59A+E129V+K177L+R179E+Q254S+M284V+V212T+Y268G+N293Y+T297N+S173N+E188P+H208Y+S242Y+K279I;

I181*+G182*+V59A+E129V+K177L+R179S+Q254S+M284V+V212T+Y268G+N293Y+T297N+A184Q+E188P+T191N

I181*+G182*+V59A+E129V+K177L+R179S+Q254S+M284V+V212T+Y268G+N293Y+T297N+A184Q+E188P+T191N+S242Y+K279I;

I181*+G182*+V59A+E129V+K177L+R179E+Q254S+M284V+V212T+Y268G+N293Y+T297N+E188P+K279W;

I181*+G182*+V59A+E129V+K177L+R179E+Q254S+M284V+V212T+Y268G+N293Y+T297N+W115D+D117Q+T133P; and wherein the variant has at least 85%, at least 90%, at least 95%, at least 96%, at least 97%, at least 98%, or at least 99% sequence identity to SEQ ID NO: 114.

It should be understood, that when referring to *Bacillus stearothermophilus* alpha-amylase and variants thereof they are normally produced in truncated form. In particular, the truncation may be so that the *Bacillus stearothermophilus* alpha-amylase shown in SEQ ID NO: 3 in WO 99/19467 or SEQ ID NO: 114 herein, or variants thereof, are truncated in the C-terminal and are typically around 491 amino acids long, such as from 480-495 amino acids long.

In a preferred embodiment the alpha-amylase variant may be an enzyme having a degree of identity of at least 60%, e.g., at least 70%, at least 80%, at least 90%, at least 95%, at least 91%, at least 92%, at least 93%, at least 94%, at least 95%, at least 96%, at least 97%, at least 98% or at least 99%, but less than 100% to the sequence shown in SEQ ID NO: 3 in WO 99/19467 or SEQ ID NO: 114 herein.

Protease Present and/or Added During Liquefaction

According to the invention a thermostable protease is optionally present and/or added during liquefaction together with an alpha-amylase, and optionally a carbohydrate-source generating enzyme, in particular a thermostable glucoamylase, and/or optionally a pullulanase.

Any protease herein contemplated as being present and/or added during liquefaction is also contemplated for expression by a fermenting organism or host cell.

Proteases are classified on the basis of their catalytic mechanism into the following groups: Serine proteases (S), Cysteine proteases (C), Aspartic proteases (A), Metallo proteases (M), and Unknown, or as yet unclassified, proteases (U), see Handbook of Proteolytic Enzymes, A. J. Barrett, N. D. Rawlings, J. F. Woessner (eds), Academic Press (1998), in particular the general introduction part.

In a preferred embodiment the thermostable protease used according to the invention is a "metallo protease" defined as a protease belonging to EC 3.4.24 (metalloendopeptidases); preferably EC 3.4.24.39 (acid metallo proteinases).

To determine whether a given protease is a metallo protease or not, reference is made to the above "Handbook of Proteolytic Enzymes" and the principles indicated therein. Such determination can be carried out for all types of proteases, be it naturally occurring or wild-type proteases; or genetically engineered or synthetic proteases.

Protease activity can be measured using any suitable assay, in which a substrate is employed, that includes peptide bonds relevant for the specificity of the protease in question. Assay-pH and assay-temperature are likewise to be adapted to the protease in question. Examples of assay-pH-values are pH 6, 7, 8, 9, 10, or 11. Examples of assay-temperatures are 30, 35, 37, 40, 45, 50, 55, 60, 65, 70 or 80° C.

Examples of protease substrates are casein, such as Azurine-Crosslinked Casein (AZCL-casein). Two protease assays are described below in the "Materials & Methods"-section, of which the so-called "AZCL-Casein Assay" is the preferred assay.

In an embodiment the thermostable protease has at least 20%, such as at least 30%, such as at least 40%, such as at least 50%, such as at least 60%, such as at least 70%, such as at least 80%, such as at least 90%, such as at least 95%, such as at least 100% of the protease activity of the Protease 196 variant or Protease Pfu determined by the AZCL-casein assay described in the "Materials & Methods" section.

There are no limitations on the origin of the protease used in a process of the invention as long as it fulfills the thermostability properties defined below.

In one embodiment the protease is of fungal origin.

The protease may be a variant of, e.g., a wild-type protease as long as the protease has the thermostability properties defined herein.

In a particular embodiment the thermostable protease is a variant of a metallo protease as defined above. In an embodiment the thermostable protease used in a process of the invention is of fungal origin, such as a fungal metallo protease, such as a fungal metallo protease derived from a strain of the genus *Thermoascus*, preferably a strain of *Thermoascus aurantiacus*, especially *Thermoascus aurantiacus* CGMCC No. 0670 (classified as EC 3.4.24.39).

In an embodiment the thermostable protease is a variant of the mature part of the metallo protease shown in SEQ ID NO: 2 disclosed in WO 2003/048353 or the mature part of SEQ ID NO: 1 in WO 2010/008841 and shown as SEQ ID NO: 115 herein further with mutations selected from below list:

S5*+D79L+S87P+A112P+D142L;
D79L+S87P+A112P+T124V+D142L;
S5*+N26R+D79L+S87P+A112P+D142L;
N26R+T46R+D79L+S87P+A112P+D142L;
T46R+D79L+S87P+T116V+D142L;
D79L+P81R+S87P+A112P+D142L;
A27K+D79L+S87P+A112P+T124V+D142L;
D79L+Y82F+S87P+A112P+T124V+D142L;
D79L+Y82F+S87P+A112P+T124V+D142L;
D79L+S87P+A112P+T124V+A126V+D142L;
D79L+S87P+A112P+D142L;
D79L+Y82F+S87P+A112P+D142L;
S38T+D79L+S87P+A112P+A126V+D142L;
D79L+Y82F+S87P+A112P+A126V+D142L;
A27K+D79L+S87P+A112P+A126V+D142L;
D79L+S87P+N98C+A112P+G135C+D142L;
D79L+S87P+A112P+D142L+T141C+M161C;
S36P+D79L+S87P+A112P+D142L;
A37P+D79L+S87P+A112P+D142L;
S49P+D79L+S87P+A112P+D142L;
S50P+D79L+S87P+A112P+D142L;
D79L+S87P+D104P+A112P+D142L;
D79L+Y82F+S87G+A112P+D142L;
S70V+D79L+Y82F+S87G+Y97W+A112P+D142L;
D79L+Y82F+S87G+Y97W+D104P+A112P+D142L;
S70V+D79L+Y82F+S87G+A112P+D142L;
D79L+Y82F+S87G+D104P+A112P+D142L;
D79L+Y82F+S87G+A112P+A126V+D142L;
Y82F+S87G+S70V+D79L+D104P+A112P+D142L;
Y82F+S87G+D79L+D104P+A112P+A126V+D142L;
A27K+D79L+Y82F+S87G+D104P+A112P+A126V+D142L;
A27K+Y82F+S87G+D104P+A112P+A126V+D142L;
A27K+D79L+Y82F+D104P+A112P+A126V+D142L;
A27K+Y82F+D104P+A112P+A126V+D142L;
A27K+D79L+S87P+A112P+D142L;
D79L+S87P+D142L.

In a preferred embodiment the thermostable protease is a variant of the metallo protease disclosed as the mature part of SEQ ID NO: 2 disclosed in WO 2003/048353 or the mature part of SEQ ID NO: 1 in WO 2010/008841 or SEQ ID NO: 115 herein with the following mutations:

D79L+S87P+A112P+D142L;
D79L+S87P+D142L; or
A27K+D79L+Y82F+S87G+D104P+A112P+A126V+D142L.

In an embodiment the protease variant has at least 75% identity preferably at least 80%, more preferably at least 85%, more preferably at least 90%, more preferably at least 91%, more preferably at least 92%, even more preferably at least 93%, most preferably at least 94%, and even most preferably at least 95%, such as even at least 96%, at least 97%, at least 98%, at least 99%, but less than 100% identity to the mature part of the polypeptide of SEQ ID NO: 2 disclosed in WO 2003/048353 or the mature part of SEQ ID NO: 1 in WO 2010/008841 or SEQ ID NO: 115 herein.

The thermostable protease may also be derived from any bacterium as long as the protease has the thermostability properties defined according to the invention. In one embodiment the protease is a serine protease, particularly a S8 protease. Preferred proteases are, serine proteases, particularly an S8 serine protease derived from a strain of *Pyrococcus*, preferably a strain of *Pyrococcus furiosus*, or derived from a strain of *Thermococcus*, preferably *Thermococcus thioreducens*, or derived from a strain of *Palaeococcus*, preferably *Palaeococcus ferrophilus*.

In an embodiment the thermostable protease is derived from a strain of the bacterium *Pyrococcus*, such as a strain of *Pyrococcus furiosus* (pfu protease).

In an embodiment the protease is one shown as SEQ ID NO: 1 in U.S. Pat. No. 6,358,726-B1 (Takara Shuzo Company), SEQ ID NO: 116 herein.

In another embodiment the thermostable protease is one disclosed in SEQ ID NO: 116 herein or a protease having at least 80% identity, such as at least 85%, such as at least 90%, such as at least 95%, such as at least 96%, such as at least 97%, such as at least 98%, such as at least 99% identity to SEQ ID NO: 1 in U.S. Pat. No. 6,358,726-B1 or SEQ ID NO: 116 herein.

The *Pyrococcus furiosus* protease is a thermostable protease according to the invention. The *Pyrococcus furiosus* protease (PfuS) was found to have a thermostability of 110% (80° C./70° C.) and 103% (90° C./70° C.) at pH 4.5 determined as described in Example 2 herein.

In an embodiment the thermostable protease is derived from a strain of the bacterium *Palaeococcus*, such as a strain of *Palaeococcus ferrophilus*. In an embodiment the protease is the one shown as SEQ ID NO: 117 herein. In another embodiment the thermostable protease is one disclosed in SEQ ID NO: 117 herein or a protease having at least 80% identity, such as at least 85%, such as at least 90%, such as at least 95%, such as at least 96%, such as at least 97%, such as at least 98%, such as at least 99% identity to SEQ ID NO: 117.

In one embodiment a thermostable protease used in a process of the invention has a thermostability value of more than 20% determined as Relative Activity at 80° C./70° C. determined as described in Example 2.

In an embodiment the protease has a thermostability of more than 30%, more than 40%, more than 50%, more than 60%, more than 70%, more than 80%, more than 90%, more than 100%, such as more than 105%, such as more than 110%, such as more than 115%, such as more than 120% determined as Relative Activity at 80° C./70° C.

In an embodiment protease has a thermostability of between 20 and 50%, such as between 20 and 40%, such as 20 and 30% determined as Relative Activity at 80° C./70° C.

In an embodiment the protease has a thermostability between 50 and 115%, such as between 50 and 70%, such as between 50 and 60%, such as between 100 and 120%, such as between 105 and 115% determined as Relative Activity at 80° C./70° C.

In an embodiment the protease has a thermostability value of more than 10% determined as Relative Activity at 85° C./70° C. determined as described in Example 2.

In an embodiment the protease has a thermostability of more than 10%, such as more than 12%, more than 14%, more than 16%, more than 18%, more than 20%, more than 30%, more than 40%, more that 50%, more than 60%, more than 70%, more than 80%, more than 90%, more than 100%, more than 110% determined as Relative Activity at 85° C./70° C.

In an embodiment the protease has a thermostability of between 10 and 50%, such as between 10 and 30%, such as between 10 and 25% determined as Relative Activity at 85° C./70° C.

In an embodiment the protease has more than 20%, more than 30%, more than 40%, more than 50%, more than 60%, more than 70%, more than 80%, more than 90% determined as Remaining Activity at 80° C.; and/or In an embodiment the protease has more than 20%, more than 30%, more than 40%, more than 50%, more than 60%, more than 70%, more than 80%, more than 90% determined as Remaining Activity at 84° C.

Determination of "Relative Activity" and "Remaining Activity" is done as described in Example 2.

In an embodiment the protease may have a thermostability for above 90, such as above 100 at 85° C. as determined using the Zein-BCA assay as disclosed in Example 3.

In an embodiment the protease has a thermostability above 60%, such as above 90%, such as above 100%, such as above 110% at 85° C. as determined using the Zein-BCA assay.

In an embodiment protease has a thermostability between 60-120, such as between 70-120%, such as between 80-120%, such as between 90-120%, such as between 100-120%, such as 110-120% at 85° C. as determined using the Zein-BCA assay.

In an embodiment the thermostable protease has at least 20%, such as at least 30%, such as at least 40%, such as at least 50%, such as at least 60%, such as at least 70%, such as at least 80%, such as at least 90%, such as at least 95%, such as at least 100% of the activity of the JTP196 protease variant or Protease Pfu determined by the AZCL-casein assay.

In an embodiment the protease is derived from a strain of *Thermobifida*, such as the *Thermobifida cellulosytica* protease shown in SEQ ID NO: 118 herein, or one having at least 60%, such as at least 70%, such as at least 75% identity, at least 76% identity, at least 77% identity, at least 78% identity, at least 79% identity, preferably at least 80%, at least 81% identity, at least 82% identity, at least 83% identity, at least 84% identity, more preferably at least 85% identity, at least 86% identity, at least 87% identity, at least 88% identity, at least 89% identity, more preferably at least 90% identity, more preferably at least 91% identity, more preferably at least 92% identity, at least 93% identity, at least 94% identity, or at least 95% identity, such as at least 96% identity, at least 97% identity, at least 98% identity, at least 99% identity to the amino acid sequence of SEQ ID NO: 118.

In an embodiment the protease is derived from a strain of *Thermobifida*, such as the *Thermobifida fusca* protease shown in SEQ ID NO: 119 herein (referred to as SEQ ID NO: 8 in WO2018/118815 A1, which is incorporated herein by reference in its entirety), or one having at least 60%, such as at least 70%, such as at least 75% identity, at least 76% identity, at least 77% identity, at least 78% identity, at least 79% identity, preferably at least 80%, at least 81% identity, at least 82% identity, at least 83% identity, at least 84% identity, more preferably at least 85% identity, at least 86% identity, at least 87% identity, at least 88% identity, at least 89% identity, more preferably at least 90% identity, more preferably at least 91% identity, more preferably at least 92% identity, at least 93% identity, at least 94% identity, or at least 95% identity, such as at least 96% identity, at least 97% identity, at least 98% identity, at least 99% identity to the amino acid sequence of SEQ ID NO: 119.

In an embodiment the protease is derived from a strain of *Thermobifida*, such as the *Thermobifida halotolerans* protease shown in SEQ ID NO: 120 herein (referred to as SEQ ID NO: 10 in WO2018/118815 A1, which is incorporated herein by reference in its entirety), or one having at least 60%, such as at least 70%, such as at least 75% identity, at least 76% identity, at least 77% identity, at least 78% identity, at least 79% identity, preferably at least 80%, at least 81% identity, at least 82% identity, at least 83% identity, at least 84% identity, more preferably at least 85% identity, at least 86% identity, at least 87% identity, at least 88% identity, at least 89% identity, more preferably at least 90% identity, more preferably at least 91% identity, more preferably at least 92% identity, at least 93% identity, at least 94% identity, or at least 95% identity, such as at least 96% identity, at least 97% identity, at least 98% identity, at least 99% identity to the amino acid sequence of SEQ ID NO: 120.

In an embodiment the protease is derived from a strain of *Thermococcus*, such as the *Thermococcus nautili* protease shown in SEQ ID NO: 121 herein (referred to as SEQ ID NO: 3 in WO2018/169780A1, which is incorporated herein by reference in its entirety), or one having at least 60%, such as at least 70%, such as at least 75% identity, at least 76% identity, at least 77% identity, at least 78% identity, at least 79% identity, preferably at least 80%, at least 81% identity, at least 82% identity, at least 83% identity, at least 84% identity, more preferably at least 85% identity, at least 86% identity, at least 87% identity, at least 88% identity, at least 89% identity, more preferably at least 90% identity, more preferably at least 91% identity, more preferably at least 92% identity, at least 93% identity, at least 94% identity, or at least 95% identity, such as at least 96% identity, at least 97% identity, at least 98% identity, at least 99% identity to the amino acid sequence of SEQ ID NO: 121.

Carbohydrate-Source Generating Enzyme Present and/or Added During Liquefaction

According to the invention a carbohydrate-source generating enzyme, in particular a glucoamylase, preferably a thermostable glucoamylase, may optionally be present and/or added during liquefaction together with an alpha-amylase and an optional thermostable protease. As mentioned above, a pullulanase may also be optionally be present and/or added during liquefaction step i).

Any carbohydrate-source generating enzymes (e.g., glucoamylase) herein contemplated as being present and/or added during liquefaction is also contemplated for expression by a fermenting organism or host cell.

The term "carbohydrate-source generating enzyme" includes any enzymes generating fermentable sugars. A carbohydrate-source generating enzyme is capable of producing a carbohydrate that can be used as an energy-source by the fermenting organism(s) in question, for instance, when used in a process of the invention for producing a fermentation product, such as ethanol. The generated carbohydrates may be converted directly or indirectly to the desired fermentation product, preferably ethanol. According to the invention a mixture of carbohydrate-source generating enzymes may be used. Specific examples include glucoamylase (being glucose generators), beta-amylase and maltogenic amylase (being maltose generators).

In a preferred embodiment the carbohydrate-source generating enzyme is thermostable. The carbohydrate-source generating enzyme, in particular thermostable glucoamylase, may be added together with or separately from the alpha-amylase and the thermostable protease.

In a specific and preferred embodiment the carbohydrate-source generating enzyme is a thermostable glucoamylase, preferably of fungal origin, preferably a filamentous fungi, such as from a strain of the genus *Penicillium*, especially a strain of *Penicillium oxalicum*, in particular the *Penicillium oxalicum* glucoamylase disclosed as SEQ ID NO: 2 in PCT/CN10/071753 published as WO 2011/127802 (which is hereby incorporated by reference) and shown in SEQ ID NO: 122 herein.

In an embodiment the thermostable glucoamylase has at least 80%, more preferably at least 85%, more preferably at least 90%, more preferably at least 91%, more preferably at least 92%, even more preferably at least 93%, most preferably at least 94%, and even most preferably at least 95%, such as even at least 96%, at least 97%, at least 98%, at least 99% or 100% identity to the mature polypeptide shown in SEQ ID NO: 2 in WO 2011/127802 or SEQ ID NOs: 23 herein.

In a preferred embodiment the carbohydrate-source generating enzyme is a variant of the *Penicillium oxalicum* glucoamylase disclosed as SEQ ID NO: 2 in WO 2011/127802 and SEQ ID NO: 122 herein, having a K79V substitution (using the mature sequence shown in SEQ ID NO: 122 for numbering). The K79V glucoamylase variant has reduced sensitivity to protease degradation relative to the parent as disclosed in co-pending U.S. application No. 61/531,189 or PCT/US12/053779 (which are hereby incorporated by reference).

In an embodiment the carbohydrate-source generating enzyme, in particular thermostable glucoamylase, is derived from *Penicillium oxalicum.*

In an embodiment the thermostable glucoamylase is a variant of the *Penicillium oxalicum* glucoamylase disclosed as SEQ ID NO: 2 in WO 2011/127802 and shown in SEQ ID NO: 122 herein. In a preferred embodiment the *Penicillium oxalicum* glucoamylase is the one disclosed as SEQ ID NO: 2 in WO 2011/127802 and shown in SEQ ID NO: 122 herein having Val (V) in position 79 (using SEQ ID NO: 122 for numbering).

In an embodiment these variants have reduced sensitivity to protease degradation.

In an embodiment these variants have improved thermostability compared to the parent.

More specifically, in an embodiment the glucoamylase has a K79V substitution (using SEQ ID NO: 122 for numbering), corresponding to the PE001 variant, and further comprises at least one of the following substitutions or combination of substitutions:

P11F+T65A+Q327F; or
P2N+P4S+P11F+T65A+Q327F; or
P11F+D26C+K33C+T65A+Q327F; or
P2N+P4S+P11F+T65A+Q327W+E501V+Y504T; or
P2N+P4S+P11F+T65A+Q327F+E501V+Y504T; or
P11F+T65A+Q327W+E501V+Y504T.

The carbohydrate-source generating enzyme, in particular, may be added in amounts from 0.1-100 micrograms EP/g, such as 0.5-50 micrograms EP/g, such as 1-25 micrograms EP/g, such as 2-12 micrograms EP/g DS.

Carbohydrate-Source Generating Enzyme Present and/or Added During Saccharification and/or Fermentation According to the invention a carbohydrate-source generating enzyme, preferably a glucoamylase, may be present and/or added during saccharification and/or fermentation.

In a preferred embodiment the carbohydrate-source generating enzyme is a glucoamylase, of fungal origin, preferably from a stain of *Aspergillus*, preferably *A. niger, A. awamori*, or *A. oryzae*; or a strain of *Trichoderma*, preferably *T. reesei*; or a strain of *Talaromyces*, preferably *T. emersonii*, or or a strain of *Trametes*, preferably *Trametes cingulata*, or a strain of *Pycnoporus*, or a strain of *Gloeophyllum*, such as a strain of *Gloeophyllum sepiarium* or *Gloeophyllum trabeum* or a strain of the *Nigrofomes.*

Any glucoamylase contemplated as being present and/or added during saccharification and/or fermentation is also contemplated for expression by a fermenting organism or host cell.

Glucoamylases

According to the invention the glucoamylase present and/or added during saccharification and/or fermentation may be derived from any suitable source, e.g., derived from a microorganism or a plant. Preferred glucoamylases are of fungal or bacterial origin, selected from the group consisting of *Aspergillus* glucoamylases, in particular *Aspergillus niger* G1 or G2 glucoamylase (Boel et al. (1984), EMBO J. 3 (5), p. 1097-1102), or variants thereof, such as those disclosed in WO 92/00381, WO 00/04136 and WO 01/04273 (from Novozymes, Denmark); the *A. awamori* glucoamylase disclosed in WO 84/02921, *Aspergillus oryzae* glucoamylase (Agric. Biol. Chem. (1991), 55 (4), p. 941-949), or variants or fragments thereof. Other *Aspergillus* glucoamylase variants include variants with enhanced thermal stability: G137A and G139A (Chen et al. (1996), Prot. Eng. 9, 499-505); D257E and D293E/Q (Chen et al. (1995), Prot. Eng. 8, 575-582); N182 (Chen et al. (1994), Biochem. J. 301, 275-281); disulphide bonds, A246C (Fierobe et al. (1996), Biochemistry, 35, 8698-8704; and introduction of Pro residues in position A435 and S436 (Li et al. (1997), Protein Eng. 10, 1199-1204.

Other glucoamylases include *Athelia rolfsii* (previously denoted *Corticium rolfsii*) glucoamylase (see U.S. Pat. No. 4,727,026 and (Nagasaka et al. (1998) "Purification and properties of the raw-starch-degrading glucoamylases from *Corticium rolfsii*, Appl Microbiol Biotechnol 50:323-330), *Talaromyces* glucoamylases, in particular derived from *Talaromyces emersonii* (WO 99/28448), *Talaromyces leycettanus* (U.S. Pat. No. Re. 32,153), *Talaromyces duponti, Talaromyces thermophilus* (U.S. Pat. No. 4,587,215). In a preferred embodiment the glucoamylase used during saccharification and/or fermentation is the *Talaromyces emersonii* glucoamylase disclosed in WO 99/28448.

Contemplated fungal glucoamylases include particularly glucoamylases derived from *Talaromyces*, preferably *T. emersonii*, or or a strain of *Trametes*, preferably *Trametes cingulata*, or a strain of *Pycnoporus*, or a strain of *Gloeophyllum*, such as a strain of *Gloeophyllum sepiarium* or *Gloeophyllum trabeum* or a strain of the *Nigrofomes*.

In one embodiment the glucoamylase is derived from a strain of the genus *Trametes*, in particular a strain of *Trametes cingulata*, disclosed in WO 2006/069289 or in SEQ ID NO: 123 herein. In one embodiment the glucoamylase is derived from a strain of the genus *Talaromyces*, in particular a strain of *Talaromyces emersonii* disclosed in SEQ ID NO: 124 herein.

In another embodiment the glucoamylase is derived from a strain of the genus *Pycnoporus*, in particular a strain of *Pycnoporus sanguineus* as described in WO 2011/066576 (SEQ ID NOs 2, 4 or 6) or SEQ ID NO: 125 herein, or from a strain of the genus *Gloeophyllum*, such as a strain of *Gloeophyllum sepiarium* or *Gloeophyllum trabeum*, in particular a strain of *Gloeophyllum* as described in WO 2011/068803 (SEQ ID NO: 2, 4, 6, 8, 10, 12, 14 or 16). In a preferred embodiment the glucoamylase is SEQ ID NO: 126 herein. In another embodiment the glucoamylase is SEQ ID NO: 127 herein. In an embodiment the glucoamylase is derived from a strain of the genus *Nigrofomes*, in particular a strain of *Nigrofomes* sp. disclosed in WO 2012/064351 as SEQ ID NO: 2. Contemplated are also glucoamylases which exhibit a high identity to any of the above mentioned glucoamylases, i.e., at least 70%, at least 75%, at least 80%, at least 85%, at least 90%, at least 95%, at least 96%, at least 97%, at least 98%, at least 99% or even 100% identity to any one of the mature parts of the enzyme sequences mentioned above, such as any of SEQ ID NOs: 123, 124, 125, 126, or 127 herein.

Glucoamylases may in an embodiment be added to the saccharification and/or fermentation in an amount of 0.0001-20 AGU/g DS, preferably 0.001-10 AGU/g DS, especially between 0.01-5 AGU/g DS, such as 0.1-2 AGU/g DS.

In an embodiment the glucoamylase is added as a blend further comprising an alpha-amylase. In a preferred embodiment the alpha-amylase is a fungal alpha-amylase, especially an acid fungal alpha-amylase. The alpha-amylase is typically a side activity.

In an embodiment the glucoamylase is a blend comprising *Talaromyces emersonii* glucoamylase disclosed in WO 99/28448 as SEQ ID NO: 7 or SEQ ID NO: 124 herein and *Trametes cingulata* glucoamylase disclosed in WO 06/069289 and SEQ ID NO: 123 herein.

In an embodiment the glucoamylase is a blend comprising *Talaromyces emersonii* glucoamylase disclosed SEQ ID NO: 124, *Trametes cingulata* glucoamylase disclosed as SEQ ID NO: 123, and *Rhizomucor pusillus* alpha-amylase with *Aspergillus niger* glucoamylase linker and SBD disclosed as V039 in Table 5 in WO 2006/069290 and as SEQ ID NO: 128 herein, preferably with the following substitutions: G128D+D143N.

In an embodiment the glucoamylase is a blend comprising *Gloeophyllum sepiarium* glucoamylase shown as SEQ ID NO: 2 in WO 2011/068803 (SEQ ID NO: 126 herein) and *Rhizomucor pusillus* with an *Aspergillus niger* glucoamylase linker and starch-binding domain (SBD), disclosed SEQ ID NO: 3 in WO 2013/006756 (SEQ ID NO: 128 herein) with the following substitutions: G128D+D143N.

In an embodiment the *Rhizomucor pusillus* alpha-amylase or the *Rhizomucor pusillus* alpha-amylase with an *Aspergillus niger* glucoamylase linker and starch-binding domain (SBD) has at least one of the following substitutions or combinations of substitutions: D165M; Y141W; Y141R; K136F; K192R; P224A; P224R; S123H+Y141W; G20S+Y141W; A76G+Y141W; G128D+Y141W; G128D+D143N; P219C+Y141W; N142D+D143N; Y141W+K192R; Y141W+D143N; Y141W+N383R; Y141W+P219C+A265C; Y141W+N142D+D143N; Y141W+K192R V410A; G128D+Y141W+D143N; Y141W+D143N+P219C; Y141W+D143N+K192R; G128D+D143N+K192R; Y141W+D143N+K192R+P219C; G128D+Y141W+D143N+K192R; or G128D+Y141W+D143N+K192R+P219C (using SEQ ID NO: 3 in WO 2013/006756 for numbering).

Commercially available compositions comprising glucoamylase include AMG 200L; AMG 300 L; SAN™ SUPER, SAN™ EXTRA L, SPIRIZYME™ PLUS, SPIRIZYME™ FUEL, SPIRIZYME™ B4U, SPIRIZYME™ ULTRA, SPIRIZYME™ EXCEL, SPIRIZYME ACHIEVE and AMG™ E (from Novozymes A/S); OPTIDEX™ 300, GC480, GC417 (from DuPont-Genencor); AMIGASE™ and AMIGASE™ PLUS (from DSM); G-ZYME™ G900, G-ZYME™ and G990 ZR (from DuPont-Genencor).

Cellulolytic Composition Present and/or Added During Saccharification and/or Fermentation According to the invention a cellulolytic composition is present during fermentation or simultaneous saccharification and fermentation (SSF).

The cellulolytic composition may be any cellulolytic composition, comprising a beta-glucosidase, a cellobiohydrolase and an endoglucanase.

Any cellulase described herein contemplated as being present and/or added during saccharification and/or fermentation is also contemplated for expression by a fermenting organism or host cell.

Examples of suitable cellulolytic composition can be found in WO 2008/151079 and co-pending patent application PCT/US12/052163 published as WO 2013/028928 which are incorporated by reference.

In preferred embodiments the cellulolytic composition is derived from a strain of *Trichoderma, Humicola*, or *Chrysosporium.*

In an embodiment the cellulolytic composition is derived from a strain of *Trichoderma reesei, Humicola insolens* and/or *Chrysosporium lucknowense.*

In an embodiment the cellulolytic composition comprises a beta-glucosidase, preferably one derived from a strain of the genus *Aspergillus*, such as *Aspergillus oryzae*, such as the one disclosed in WO 2002/095014 or the fusion protein having beta-glucosidase activity disclosed in WO 2008/057637, or *Aspergillus fumigatus*, such as one disclosed in WO 2005/047499 or SEQ ID NO: 110 herein or an *Aspergillus fumigatus* beta-glucosidase variant disclosed in WO 2012/044915 (Novozymes), such as one with the following substitutions F100D, S283G, N456E, F512Y; or a strain of the genus a strain *Penicillium*, such as a strain of the *Penicillium brasilianum* disclosed in WO 2007/019442, or a strain of the genus *Trichoderma*, such as a strain of *Trichoderma reesei.*

In an embodiment the cellulolytic composition comprises a GH61 polypeptide having cellulolytic enhancing activity such as one derived from the genus *Thermoascus*, such as a strain of *Thermoascus aurantiacus*, such as the one described in WO 2005/074656 as SEQ ID NO: 2; or one derived from the genus *Thielavia*, such as a strain of *Thielavia terrestris*, such as the one described in WO 2005/074647 as SEQ ID NO: 7 and SEQ ID NO: 8; or one derived from a strain of *Aspergillus*, such as a strain of *Aspergillus fumigatus*, such as the one described in WO 2010/138754 as SEQ ID NO: 1 and SEQ ID NO: 2; or one derived from a strain derived from *Penicillium*, such as a strain of *Penicillium emersonii*, such as the one disclosed in WO 2011/041397 or SEQ ID NO: 109 herein.

In an embodiment the cellulolytic composition comprises a cellobiohydrolase I (CBH I), such as one derived from a strain of the genus *Aspergillus*, such as a strain of *Aspergillus fumigatus*, such as the Cel7a CBHI disclosed in SEQ ID NO: 2 in WO 2011/057140 or SEQ ID NO: 111 herein, or a strain of the genus *Trichoderma*, such as a strain of *Trichoderma reesei.*

In an embodiment the cellulolytic composition comprises a cellobiohydrolase II (CBH II, such as one derived from a strain of the genus *Aspergillus*, such as a strain of *Aspergillus fumigatus* or SEQ ID NO: 112 herein; or a strain of the genus *Trichoderma*, such as *Trichoderma reesei*, or a strain of the genus *Thielavia*, such as a strain of *Thielavia terrestris*, such as cellobiohydrolase II CEL6A from *Thielavia terrestris.*

In an embodiment the cellulolytic composition comprises a GH61 polypeptide having cellulolytic enhancing activity and a beta-glucosidase.

In an embodiment the cellulolytic composition comprises a GH61 polypeptide having cellulolytic enhancing activity, a beta-glucosidase, and a CBH I.

In an embodiment the cellulolytic composition comprises a GH61 polypeptide having cellulolytic enhancing activity, a beta-glucosidase, a CBH I, and a CBH II.

In an embodiment the cellulolytic composition is a *Trichoderma reesei* cellulolytic enzyme composition, further comprising *Thermoascus aurantiacus* GH61A polypeptide having cellulolytic enhancing activity (SEQ ID NO: 2 in WO 2005/074656), and *Aspergillus oryzae* beta-glucosidase fusion protein (WO 2008/057637).

In an embodiment the cellulolytic composition is a *Trichoderma reesei* cellulolytic enzyme composition, further comprising *Thermoascus aurantiacus* GH61A polypeptide having cellulolytic enhancing activity (SEQ ID NO: 2 in WO 2005/074656) and *Aspergillus fumigatus* beta-glucosidase (SEQ ID NO: 2 of WO 2005/047499) or SEQ ID NO: 110 herein.

In an embodiment the cellulolytic composition is a *Trichoderma reesei* cellulolytic enzyme composition further comprising *Penicillium emersonii* GH61A polypeptide having cellulolytic enhancing activity disclosed in WO 2011/041397 and *Aspergillus fumigatus* beta-glucosidase (SEQ ID NO: 2 of WO 2005/047499) or SEQ ID NO: 110 herein or a variant thereof with the following substitutions F100D, S283G, N456E, F512Y.

In an embodiment, the cellulolytic composition, for example a *Trichoderma reesei* cellulolytic enzyme composition, comprises one or more polypeptides selected from the group consisting of:

beta-glucosidase;

cellobiohydrolase I; and endoglucanase I, or a mixture of two or three thereof.

In an embodiment, the cellulolytic composition, for example a *Trichoderma reesei* cellulolytic enzyme composition, comprises one or more of the following components:

(i) an *Aspergillus fumigatus* beta-glucosidase or a variant thereof;

(ii) an *Aspergillus fumigatus* cellobiohydrolase I; and (iii) a *Trichoderma reesei* endoglucanase I.

In an embodiment, the cellulolytic composition is a *Trichoderma reesei* cellulolytic composition further comprising:

(i) an *Aspergillus fumigatus* beta-glucosidase disclosed in SEQ ID NO: 110 or a variant thereof with the following substitutions: F100D, S283G, N456E, F512Y having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 110; (ii) a cellobiohydrolase I (CBH I), such as one derived from a strain of the genus *Aspergillus*, such as a strain of *Aspergillus fumigatus*, such as the CBHI disclosed as SEQ ID NO: 111, or a CBHI having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 111; and (iii) an endoglucanase I (EGI), such as one derived from a strain of the genus *Trichoderma*, such as a strain of *Trichoderma reesei*, such as the EGI disclosed as SEQ ID NO: 113, or an EGI having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 113.

In a preferred embodiment the cellulolytic composition comprising one or more of the following components:

(i) an *Aspergillus fumigatus* cellobiohydrolase I;

(ii) an *Aspergillus fumigatus* cellobiohydrolase II;

(iii) an *Aspergillus fumigatus* beta-glucosidase or variant thereof; and (iv) a *Penicillium* sp. GH61 polypeptide having cellulolytic enhancing activity; or homologs thereof.

In an preferred embodiment the cellulolytic composition is derived from *Trichoderma reesei* comprising GH61A polypeptide having cellulolytic enhancing activity derived from a strain of *Penicillium emersonii* (SEQ ID NO: 2 in WO 2011/041397 or SEQ ID NO: 109 herein), *Aspergillus fumigatus* beta-glucosidase (SEQ ID NO: 2 in WO 2005/047499 SEQ ID NO: 110 herein) variant F100D, S283G, N456E, F512Y) disclosed in WO 2012/044915; *Aspergillus fumigatus* Cel7A CBH1 disclosed as SEQ ID NO: 6 in WO2011/057140 (SEQ ID NO: 111 herein) and *Aspergillus fumigatus* CBH II disclosed as SEQ ID NO: 18 in WO 2011/057140 (SEQ ID NO: 112 herein).

In an embodiment the cellulolytic composition is dosed from 0.0001-3 mg EP/g DS, preferably, 0.0005-2 mg EP/g DS, preferably 0.001-1 mg/g DS, more preferably 0.005-0.5 mg EP/g DS, and even more preferably 0.01-0.1 mg EP/g DS.

Compositions

The present invention also relates to compositions comprising a polypeptide having pectinase activity (e.g., polygalacturonase activity, rhamnogalacturonase activity, pectin methyl esterase, pectin lyase activity, pectin acetyl esterase activity, rhamnogalacturonan lyase activity, beta-galactanase activity, etc.). The compositions may comprise a polypeptide having pectinase activity (e.g., a polygalacturonase from the GH28 family, a rhamnogalacturonase, from the GH28 family, a pectin methyl esterase from the CE8 family, a pectin lyase from the PL1 family, a pectin acetyl esterase from the CE12 family or CE16 family, a rhamnogalacturonan lyase from the PL4 family, a beta-galactanase from the GH53 family, and combinations thereof), as the major enzymatic component, e.g., a mono-component composition.

An aspect of the present invention relates to a compositions for increasing enzyme accessibility of cellulose fiber in starch-containing or cellulosic-containing material to cellulolytic degradation.

In one embodiment a composition for increasing enzyme accessibility of cellulose fiber in starch-containing material or cellulosic-containing material to cellulolytic degradation comprises a pectinolytic composition comprising at least one, at least two, or at least three polypeptides having pectinase activity.

In one embodiment a composition for increasing enzyme accessibility of cellulose fiber in starch-containing material or cellulosic-containing material to cellulolytic degradation comprises a pectinolytic composition comprising at least one, at least two, or at least three polypeptides having pectinase activity, wherein the at least one, at least two, or at least three polypeptides having pectinase activity have a different pectinase activity selected from the group consisting of polygalacturonase activity, rhamnogalacturonase activity, pectin methyl esterase, pectin lyase activity, pectin acetyl esterase activity, rhamnogalacturonan lyase activity, beta-galactanase activity, and combinations thereof.

In one embodiment a composition for increasing enzyme accessibility of cellulose fiber in starch-containing material or cellulosic-containing material to cellulolytic degradation comprises a pectinolytic composition comprising at least one, at least two, or at least three polypeptides having pectinase activity, wherein the at least one, at least two, or at least three polypeptides having pectinase activity are selected from the group consisting of a polygalacturonase from the GH28 family, a rhamnogalacturonase, from the GH28 family, a pectin methyl esterase from the CE8 family, a pectin lyase from the PL1 family, a pectin acetyl esterase from the CE12 family or CE16 family, a rhamnogalacturonan lyase from the PL4 family, a beta-galactanase from the GH53 family, and combinations thereof.

In one embodiment a composition for increasing enzyme accessibility of cellulose fiber in starch-containing material or cellulosic-containing material to cellulolytic degradation comprises a pectinolytic composition comprising at least one, at least two, or at least three polypeptides and a cellulolytic composition comprising at least one, at least two, or at least three polypeptides having cellulase activity, wherein the at least one, at least two, or at least three polypeptides having pectinase activity have a different pectinase activity selected from the group consisting of polygalacturonase activity, rhamnogalacturonase activity, pectin methyl esterase, pectin lyase activity, pectin acetyl esterase activity, rhamnogalacturonan lyase activity, beta-galactanase activity, and combinations thereof, and wherein the at least one, at least two, or at least three polypeptides having cellulase activity are selected from the group consisting of beta-glucosidase, cellobiohydrolase, and endoglucanase. The cellobiohydrolase may be a cellobiohydrolase I or cellobiohydrolase II.

In one embodiment a composition for increasing enzyme accessibility of cellulose fiber in starch-containing material or cellulosic-containing material to cellulolytic degradation comprises a pectinolytic composition comprising at least one, at least two, or at least three polypeptides having pectinase activity and a cellulolytic composition comprising at least one, at least two, or at least three polypeptides having cellulase activity, wherein the at least one, at least two, or at least three polypeptides having pectinase activity are selected from the group consisting of a polygalacturonase from the GH28 family, a rhamnogalacturonase, from the GH28 family, a pectin methyl esterase from the CE8 family, a pectin lyase from the PL1 family, a pectin acetyl esterase from the CE12 family or CE16 family, a rhamnogalacturonan lyase from the PL4 family, a beta-galactanase from the GH53 family, and combinations thereof, and wherein the at least one, at least two, or at least three polypeptides having cellulase activity are selected from the group consisting of beta-glucosidase, cellobiohydrolase I, cellobiohydrolase II, endoglucanase, and a GH61A polypeptide having cellulolytic enhancing activity.

In one embodiment a composition for increasing enzyme accessibility of cellulose fiber in starch-containing material or cellulosic-containing material to cellulolytic degradation comprises a pectinolytic composition comprising at least one, at least two, or at least three polypeptides, a cellulolytic composition comprising at least one, at least two, or at least three polypeptides having cellulase activity, a glucoamylase, and alpha-amylase, and a trehalase, wherein the at least one, at least two, or at least three polypeptides having pectinase activity have a different pectinase activity selected from the group consisting of polygalacturonase activity, rhamnogalacturonase activity, pectin methyl esterase, pectin lyase activity, pectin acetyl esterase activity, rhamnogalacturonan lyase activity, beta-galactanase activity, and combinations thereof, and wherein the at least one, at least two, or at least three polypeptides having cellulase activity are selected from the group consisting of beta-glucosidase, cellobiohydrolase, and endoglucanase. The cellobiohydrolase may be a cellobiohydrolase I or cellobiohydrolase II.

In one embodiment a composition for increasing enzyme accessibility of cellulose fiber in starch-containing material or cellulosic-containing material to cellulolytic degradation comprises a pectinolytic composition comprising at least one, at least two, or at least three polypeptides having pectinase activity, a cellulolytic composition comprising at least one, at least two, or at least three polypeptides having cellulase activity, and a glucoamylase, alpha-amylase, and a trehalase, wherein the at least one, at least two, or at least three polypeptides having pectinase activity are selected from the group consisting of a polygalacturonase from the GH28 family, a rhamnogalacturonase, from the GH28 family, a pectin methyl esterase from the CE8 family, a pectin lyase from the PL1 family, a pectin acetyl esterase from the CE12 family or CE16 family, a rhamnogalacturonan lyase from the PL4 family, a beta-galactanase from the GH53 family, and combinations thereof, and wherein the at least one, at least two, or at least three polypeptides having cellulase activity are selected from the group consisting of beta-glucosidase, cellobiohydrolase I, cellobiohydrolase II, endoglucanase, and a GH61A polypeptide having cellulolytic enhancing activity.

In one embodiment a composition for increasing enzyme accessibility of cellulose fiber in starch-containing material or cellulosic-containing material to cellulolytic degradation comprises:

(i) a pectinolytic composition comprising a polygalacturonase and a pectin methyl esterase;
(ii) a cellulolytic composition comprising a beta-glucosidase, a cellobiohydrolase, and an endoglucanase;
(iii) an optional glucoamylase;
(iv) an optional alpha-amylase; and
(v) an optional trehalase.

In one embodiment a composition for increasing enzyme accessibility of cellulose fiber in starch-containing material or cellulosic-containing material to cellulolytic degradation comprises:

(i) a pectinolytic composition comprising a pectin lyase;
(ii) a cellulolytic composition comprising a beta-glucosidase, a cellobiohydrolase, and an endoglucanase;
(iii) an optional glucoamylase;
(iv) an optional alpha-amylase; and
(v) an optional trehalase.

In one embodiment a composition for increasing enzyme accessibility of cellulose fiber in starch-containing material or cellulosic-containing material to cellulolytic degradation comprises:

(i) a pectinolytic composition comprising a polygalacturonase, a pectin methyl esterase, and a pectin lyase;
(ii) a cellulolytic composition comprising a beta-glucosidase, a cellobiohydrolase, and an endoglucanase;
(iii) an optional glucoamylase;
(iv) an optional alpha-amylase; and
(v) an optional trehalase.

In one embodiment a composition for increasing enzyme accessibility of cellulose fiber in starch-containing material or cellulosic-containing material to cellulolytic degradation comprises:

(i) a pectinolytic composition comprising a polygalacturonase from the GH28 family and a pectin methyl esterase from the CE8 family;
(ii) a cellulolytic composition comprising a beta-glucosidase, a cellobiohydrolase I, and an endoglucanase I;
(iii) an optional glucoamylase;
(iv) an optional alpha-amylase; and
(v) an optional trehalase.

In one embodiment a composition for increasing enzyme accessibility of cellulose fiber in starch-containing material or cellulosic-containing material to cellulolytic degradation comprises:

(i) a pectinolytic composition comprising a polygalacturonase from the GH28 family and a pectin methyl esterase from the CE8 family;
(ii) a cellulolytic composition comprising an *Aspergillus* beta-glucosidase, an *Aspergillus* cellobiohydrolase I, and a *Trichoderma* endoglucanase I;
(iii) an optional glucoamylase;
(iv) an optional alpha-amylase; and
(v) an optional trehalase.

In one embodiment a composition for increasing enzyme accessibility of cellulose fiber in starch-containing material or cellulosic-containing material to cellulolytic degradation comprises:

(i) a pectinolytic composition comprising a polygalacturonase from the GH28 family and a pectin methyl esterase from the CE8 family;
(ii) a cellulolytic composition comprising an *Aspergillus fumigatus* beta-glucosidase, an *Aspergillus fumigatus* cellobiohydrolase I, and a *Trichoderma reesei* endoglucanase I;
(iii) an optional glucoamylase;
(iv) an optional alpha-amylase; and
(v) an optional trehalase.

In one embodiment a composition for increasing enzyme accessibility of cellulose fiber in starch-containing material or cellulosic-containing material to cellulolytic degradation comprises:

(i) a pectinolytic composition comprising a polygalacturonase from the GH28 family and a pectin methyl esterase from the CE8 family;
(ii) a cellulolytic composition derived from *Trichoderma reesei, Humicola insulens*, or *Chrysosporium lucknowense* and comprising an *Aspergillus fumigatus* beta-glucosidase, an *Aspergillus fumigatus* cellobiohydrolase I, and a *Trichoderma reesei* endoglucanase I;
(iii) an optional glucoamylase;
(iv) an optional alpha-amylase; and
(v) an optional trehalase.

In one embodiment a composition for increasing enzyme accessibility of cellulose fiber in starch-containing material or cellulosic-containing material to cellulolytic degradation comprises:

(i) a pectinolytic composition comprising a polygalacturonase from the GH28 family and a pectin methyl esterase from the CE8 family, wherein the polygalacturonase from the GH28 family is selected from the group consisting of a polypeptide comprising, consisting of, or consisting essentially of the mature polypeptide of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, or SEQ ID NO: 44, or is a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, or SEQ ID NO: 44, or the full-length polypeptide of SEQ ID NO: 3, SEQ ID NO: 6, SEQ ID NO: 9, SEQ ID NO: 12, SEQ ID NO: 15, SEQ ID NO: 18, SEQ ID NO: 21, SEQ ID NO: 24, SEQ ID NO: 27, SEQ ID NO: 30, SEQ ID NO: 33, SEQ ID NO: 36, SEQ ID NO: 39, SEQ ID NO: 42, or SEQ ID NO: 45, which has polygalacturonase activity, and wherein the pectin methyl esterase is selected from the group consisting of the mature polypeptide of SEQ ID NO: 65, SEQ ID NO: 68, SEQ ID NO: 71, and SEQ ID NO: 74, or is a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 65, SEQ ID NO: 68, SEQ ID NO: 71, and SEQ ID NO: 74, or the full-length polypeptide of SEQ ID NO: 66, SEQ ID NO: 69, SEQ ID NO: 72, or SEQ ID NO: 75, which has pectin methyl esterase activity;

(ii) a cellulolytic composition derived from *Trichoderma reesei, Humicola insulens*, or *Chrysosporium lucknowense* and comprising an *Aspergillus fumigatus* beta-glucosidase, an *Aspergillus fumigatus* cellobiohydrolase I, and a *Trichoderma reesei* endoglucanase I;

(iii) an optional glucoamylase;

(iv) an optional alpha-amylase; and (v) an optional trehalase.

In one embodiment a composition for increasing enzyme accessibility of cellulose fiber in starch-containing material or cellulosic-containing material to cellulolytic degradation comprises:

(i) a pectinolytic composition comprising a polygalacturonase from the GH28 family and a pectin methyl esterase from the CE8 family, wherein the polygalacturonase from the GH28 family is selected from the group consisting of a polypeptide comprising, consisting of, or consisting essentially of the mature polypeptide of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, or SEQ ID NO: 44, or is a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, or SEQ ID NO: 44, or the full-length polypeptide of SEQ ID NO: 3, SEQ ID NO: 6, SEQ ID NO: 9, SEQ ID NO: 12, SEQ ID NO: 15, SEQ ID NO: 18, SEQ ID NO: 21, SEQ ID NO: 24, SEQ ID NO: 27, SEQ ID NO: 30, SEQ ID NO: 33, SEQ ID NO: 36, SEQ ID NO: 39, SEQ ID NO: 42, or SEQ ID NO: 45, which has polygalacturonase activity, and wherein the pectin methyl esterase is selected from the group consisting of the mature polypeptide of SEQ ID NO: 65, SEQ ID NO: 68, SEQ ID NO: 71, and SEQ ID NO: 74, or is a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 65, SEQ ID NO: 68, SEQ ID NO: 71, or SEQ ID NO: 74, or the full-length polypeptide of SEQ ID NO: 66, SEQ ID NO: 69, SEQ ID NO: 72, or SEQ ID NO: 75, which has pectin methyl esterase activity;

(ii) a cellulolytic composition derived from *Trichoderma reesei* and comprising a beta-glucosidase comprising, consisting of, or consisting essentially of the mature polypeptide of SEQ ID NO: 110 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 110, which has beta-glucosidase activity, a cellobiohydrolase I comprising, consisting of, or consisting essentially of the mature polypeptide of SEQ ID NO: 111 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 111, which has cellobiohydrolase activity, and an endoglucanase I comprising, consisting of, or consisting essentially of the mature polypeptide of SEQ ID NO: 113 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 113, which has endoglucanase activity;

(iii) an optional glucoamylase;

(iv) an optional alpha-amylase; and (v) an optional trehalase.

In one embodiment a composition for increasing enzyme accessibility of cellulose fiber in starch-containing material or cellulosic-containing material to cellulolytic degradation comprises:

(i) a pectinolytic composition comprising a polygalacturonase from the GH28 family and a pectin methyl esterase from the CE8 family, wherein the polygalacturonase from the GH28 family comprises, consists of, or consists essentially of the mature polypeptide of SEQ ID NO: 2, or is a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 2 or SEQ ID NO: 3, which has polygalacturonase activity, and wherein the pectin methyl esterase comprises, consists of, or consists essentially of the mature polypeptide of the mature polypeptide of SEQ ID NO: 65, or is a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 65 or SEQ ID NO: 66, which has pectin methyl esterase activity;

(ii) a cellulolytic composition derived from *Trichoderma reesei* and comprising a beta-glucosidase comprising, consisting of, or consisting essentially of the mature polypeptide of SEQ ID NO: 110 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 110, which has beta-glucosidase activity, a cellobiohydrolase I comprising, consisting of, or consisting essentially of the mature polypeptide of SEQ ID NO: 111 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 111, which has cellobiohydrolase activity, and an endoglucanase I comprising, consisting of, or consisting essentially of the mature polypeptide of SEQ ID NO: 113 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 113, which has endoglucanase activity;

(iii) an optional glucoamylase;

(iv) an optional alpha-amylase; and (v) an optional trehalase.

In one embodiment a composition for increasing enzyme accessibility of cellulose fiber in starch-containing material or cellulosic-containing material to cellulolytic degradation comprises:

(i) a pectinolytic composition comprising a polygalacturonase from the GH28 family and a pectin methyl esterase from the CE8 family;

(ii) a cellulolytic composition comprising a beta-glucosidase, a cellobiohydrolase I, a cellobiohydrolase II, a GH61 polypeptide having cellulolytic enhancing activity, and an endoglucanase I;

(iii) an optional glucoamylase;

(iv) an optional alpha-amylase; and (v) an optional trehalase.

In one embodiment a composition for increasing enzyme accessibility of cellulose fiber in starch-containing material or cellulosic-containing material to cellulolytic degradation comprises:

(i) a pectinolytic composition comprising a polygalacturonase from the GH28 family and a pectin methyl esterase from the CE8 family;

(ii) a cellulolytic composition comprising an *Aspergillus* beta-glucosidase, an *Aspergillus* cellobiohydrolase I, an *Aspergillus* cellobiohydrolase II, a *Penicillium* GH61 polypeptide having cellulolytic enhancing activity, and a *Trichoderma* endoglucanase I;

(iii) an optional glucoamylase;

(iv) an optional alpha-amylase; and (v) an optional trehalase.

In one embodiment a composition for increasing enzyme accessibility of cellulose fiber in starch-containing material or cellulosic-containing material to cellulolytic degradation comprises:

(i) a pectinolytic composition comprising a polygalacturonase from the GH28 family and a pectin methyl esterase from the CE8 family;

(ii) a cellulolytic composition comprising an *Aspergillus fumigatus* beta-glucosidase, an *Aspergillus fumigatus* cellobiohydrolase I, an *Aspergillus fumigatus* cellobiohydrolase II, a *Penicillium emersonii* GH61 polypeptide having cellulolytic enhancing activity, and a *Trichoderma reesei* endoglucanase I;

(iii) an optional glucoamylase;

(iv) an optional alpha-amylase; and (v) an optional trehalase.

In one embodiment a composition for increasing enzyme accessibility of cellulose fiber in starch-containing material or cellulosic-containing material to cellulolytic degradation comprises:

(i) a pectinolytic composition comprising a polygalacturonase from the GH28 family and a pectin methyl esterase from the CE8 family;

(ii) a cellulolytic composition derived from *Trichoderma reesei, Humicola insulens*, or *Chrysosporium lucknowense* and comprising an *Aspergillus fumigatus* beta-glucosidase, an *Aspergillus fumigatus* cellobiohydrolase I, an *Aspergillus fumigatus* cellobiohydrolase II, a *Penicillium emersonii* GH61 polypeptide having cellulolytic enhancing activity, and a *Trichoderma reesei* endoglucanase I;

(iii) an optional glucoamylase;

(iv) an optional alpha-amylase; and (v) an optional trehalase.

In one embodiment a composition for increasing enzyme accessibility of cellulose fiber in starch-containing material or cellulosic-containing material to cellulolytic degradation comprises:

(i) a pectinolytic composition comprising a polygalacturonase from the GH28 family and a pectin methyl esterase from the CE8 family, wherein the polygalacturonase from the GH28 family is selected from the group consisting of a polypeptide comprising, consisting of, or consisting essentially of the mature polypeptide of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, or SEQ ID NO: 44, or is a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, or SEQ ID NO: 44, or the full-length polypeptide of SEQ ID NO: 3, SEQ ID NO: 6, SEQ ID NO: 9, SEQ ID NO: 12, SEQ ID NO: 15, SEQ ID NO: 18, SEQ ID NO: 21, SEQ ID NO: 24, SEQ ID NO: 27, SEQ ID NO: 30, SEQ ID NO: 33, SEQ ID NO: 36, SEQ ID NO: 39, SEQ ID NO: 42, or SEQ ID NO: 45, which has polygalacturonase activity, and wherein the pectin methyl esterase is selected from the group consisting of the mature polypeptide of SEQ ID NO: 65, SEQ ID NO: 68, SEQ ID NO: 71, and SEQ ID NO: 74, or is a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 65, SEQ ID NO: 68, SEQ ID NO: 71, and SEQ ID NO: 74, or the full-length polypeptide of SEQ ID NO: 66, SEQ ID NO: 69, SEQ ID NO: 72, or SEQ ID NO: 75, which has pectin methyl esterase activity;

(ii) a cellulolytic composition derived from *Trichoderma reesei, Humicola insulens*, or *Chrysosporium lucknowense* and comprising an *Aspergillus fumigatus* beta-glucosidase, an *Aspergillus fumigatus* cellobiohydrolase I, an *Aspergillus fumigatus* cellobiohydrolase II, a *Penicillium emersonii* GH61 polypeptide having cellulolytic enhancing activity, and a *Trichoderma reesei* endoglucanase I;

(iii) an optional glucoamylase;

(iv) an optional alpha-amylase; and (v) an optional trehalase.

In one embodiment a composition for increasing enzyme accessibility of cellulose fiber in starch-containing material or cellulosic-containing material to cellulolytic degradation comprises:

(i) a pectinolytic composition comprising a polygalacturonase from the GH28 family and a pectin methyl esterase from the CE8 family, wherein the polygalacturonase from the GH28 family is selected from the group consisting of a polypeptide comprising, consisting of, or consisting essentially of the mature polypeptide of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, or SEQ ID NO: 44, or is a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, or SEQ ID NO: 44, or the full-length polypeptide of SEQ ID NO: 3, SEQ ID NO: 6, SEQ ID NO: 9, SEQ ID NO: 12, SEQ ID NO: 15, SEQ ID NO: 18, SEQ ID NO: 21, SEQ ID NO: 24, SEQ ID NO: 27, SEQ ID NO: 30, SEQ ID NO: 33, SEQ ID NO: 36, SEQ ID NO: 39, SEQ ID NO: 42, or SEQ ID NO: 45, which has polygalacturonase activity, and wherein the pectin methyl esterase is selected from the group consisting of the mature polypeptide of SEQ ID NO: 65, SEQ ID NO: 68, SEQ ID NO: 71, and SEQ ID NO: 74, or is a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 65, SEQ ID NO: 68, SEQ ID NO: 71, and SEQ ID NO: 74, or the full-length polypeptide of SEQ ID NO: 66, SEQ ID NO: 69, SEQ ID NO: 72, and SEQ ID NO: 75, which has pectin methyl esterase activity;

(ii) a cellulolytic composition derived from *Trichoderma reesei* and comprising a GH61 polypeptide having cellulolytic enhancing activity comprising, consisting of, or consisting essentially of the mature polypeptide of SEQ ID NO: 109, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 109, which has cellulolytic enhancing activity, a beta-glucosidase comprising, consisting of, or consisting essentially of the mature polypeptide of SEQ ID NO: 110 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 110, which has beta-glucosidase activity, a cellobiohydrolase I comprising, consisting of, or consisting essentially of the mature polypeptide of SEQ ID NO: 111 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 111, which has cellobiohydrolase activity, a cellobiohydrolase II comprising, consisting of, or consisting essentially of the mature polypeptide of SEQ ID NO: 112 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 112, which has cellobiohydrolase activity and an endoglucanase I comprising, consisting of, or consisting essentially of the mature polypeptide of SEQ ID NO: 113 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 113, which has endoglucanase activity;

(iii) an optional glucoamylase;

(iv) an optional alpha-amylase; and (v) an optional trehalase.

In one embodiment a composition for increasing enzyme accessibility of cellulose fiber in starch-containing material or cellulosic-containing material to cellulolytic degradation comprises:

(i) a pectinolytic composition comprising a polygalacturonase from the GH28 family and a pectin methyl esterase from the CE8 family, wherein the polygalacturonase from the GH28 family is selected from the group consisting of a polypeptide comprising, consisting of, or consisting essentially of the mature polypeptide of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, or SEQ ID NO: 43, or is a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, or SEQ ID NO: 43, or the full-length polypeptide of SEQ ID NO: 3, SEQ ID NO: 6, SEQ ID NO: 9, SEQ ID NO: 12, SEQ ID NO: 15, SEQ ID NO: 18, SEQ ID NO: 21, SEQ ID NO: 24, SEQ ID NO: 27, SEQ ID NO: 30, SEQ ID NO: 33, SEQ ID NO: 36, SEQ ID NO: 39, SEQ ID NO: 42, or SEQ ID NO: 45, which has polygalacturonase activity, and wherein the pectin methyl esterase is selected from the group consisting of the mature polypeptide of SEQ ID NO: 65, SEQ ID NO: 68, SEQ ID NO: 71, and SEQ ID NO: 74, or is a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 65, SEQ ID NO: 68, SEQ ID NO: 71, and SEQ ID NO: 74, or the full-length polypeptide of SEQ ID NO: 66, SEQ ID NO: 69, SEQ ID NO: 72, and SEQ ID NO: 75, which has pectin methyl esterase activity;

(ii) a cellulolytic composition derived from *Trichoderma reesei* and comprising a beta-glucosidase comprising, consisting of, or consisting essentially of the mature polypeptide of SEQ ID NO: 110 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 110, which has beta-glucosidase activity, a cellobiohydrolase I comprising, consisting of, or consisting essentially of the mature polypeptide of SEQ ID NO: 111 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 111, which has cellobiohydrolase activity, and an endoglucanase I comprising, consisting of, or consisting essentially of the mature polypeptide of SEQ ID NO: 113 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 113, which has endoglucanase activity;

(iii) a glucoamylase blend comprising, consisting or consisting essentially of a first glucoamylase having the amino acid sequence set forth in SEQ ID NO: 123, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the amino acid sequence of SEQ ID NO: 123, which has glucoamylase activity, and a second glucoamylase having the amino acid sequence set forth in SEQ ID NO: 124, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the amino acid sequence of SEQ ID NO: 124, which has glucoamylase activity;

(iv) a alpha-amylase comprising, consisting of, or consisting essentially of the amino acid sequence set forth in SEQ ID NO: 128 with the following substitutions: G128D+D143N, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the amino acid sequence of SEQ ID NO: 124, which has alpha-amylase activity; and (v) an optional trehalase.

In one embodiment a composition for increasing enzyme accessibility of cellulose fiber in starch-containing material or cellulosic-containing material to cellulolytic degradation comprises:

(i) a pectinolytic composition comprising a polygalacturonase from the GH28 family and a pectin methyl esterase from the CE8 family, wherein the polygalacturonase from the GH28 family comprises, consists of, or consists essentially of the mature polypeptide of SEQ ID NO: 2, or is a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 2 or the full-length polypeptide of SEQ ID NO: 3, which has polygalacturonase activity, and wherein the pectin methyl esterase comprises, consists of, or consists essentially of the mature polypeptide of SEQ ID NO: 65, or is a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 65, or the full-length polypeptide of SEQ ID NO: 66, which has pectin methyl esterase activity;

(ii) a cellulolytic composition derived from *Trichoderma reesei* and comprising a beta-glucosidase comprising, consisting of, or consisting essentially of the mature polypeptide of SEQ ID NO: 110 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 110, which has beta-glucosidase activity, a cellobiohydrolase I comprising, consisting of, or consisting essentially of the mature polypeptide of SEQ ID NO: 111 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 111, which has cellobiohydrolase activity, and an endoglucanase I comprising, consisting of, or consisting essentially of the mature polypeptide of SEQ ID NO: 113 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 113, which has endoglucanase activity;

(iii) a glucoamylase blend comprising, consisting or consisting essentially of a first glucoamylase having the amino acid sequence set forth in SEQ ID NO: 123, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the amino acid sequence of SEQ ID NO: 123, which has glucoamylase activity, and a second glucoamylase having the amino acid sequence set forth in SEQ ID NO: 124, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the amino acid sequence of SEQ ID NO: 124, which has glucoamylase activity, (iv) an alpha-amylase comprising, consisting of, or consisting essentially of the amino acid sequence set forth in SEQ ID NO: 128 with the following substitutions: G128D+D143N, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the amino acid sequence of SEQ ID NO: 124, which has alpha-amylase activity; and (v) an optional trehalase.

In one embodiment a composition for increasing enzyme accessibility of cellulose fiber in starch-containing material or cellulosic-containing material to cellulolytic degradation comprises:

(i) a pectinolytic composition comprising a polygalacturonase from the GH28 family and a pectin methyl esterase from the CE8 family, wherein the polygalacturonase from the GH28 family is selected from the group consisting of a polypeptide comprising, consisting of, or consisting essentially of the mature polypeptide of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, or SEQ ID NO: 43, or is a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, or SEQ ID NO: 43, or the full-length polypeptide of SEQ ID NO: 3, SEQ ID NO: 6, SEQ ID NO: 9, SEQ ID NO: 12, SEQ ID NO: 15, SEQ ID NO: 18, SEQ ID NO: 21, SEQ ID NO: 24, SEQ ID NO: 27, SEQ ID NO: 30, SEQ ID NO: 33, SEQ ID NO: 36, SEQ ID NO: 39, SEQ ID NO: 42, or SEQ ID NO: 45, which has polygalacturonase activity, and wherein the pectin methyl esterase is selected from the group consisting of the mature polypeptide of SEQ ID NO: 65, SEQ ID NO: 68, SEQ ID NO: 71, and SEQ ID NO: 74, or is a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 65, SEQ ID NO: 68, SEQ ID NO: 71, and SEQ ID NO: 74, or the full-length polypeptide of SEQ ID NO: 66, SEQ ID NO: 69, SEQ ID NO: 72, and SEQ ID NO: 75, which has pectin methyl esterase activity;

(ii) a cellulolytic composition derived from *Trichoderma reesei* and comprising a beta-glucosidase comprising, consisting of, or consisting essentially of the mature polypeptide of SEQ ID NO: 110 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 110, which has beta-glucosidase activity, a cellobiohydrolase I comprising, consisting of, or consisting essentially of the mature polypeptide of SEQ ID NO: 111 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 111, which has cellobiohydrolase activity, and an endoglucanase I comprising, consisting of, or consisting essentially of the mature polypeptide of SEQ ID NO: 113 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 113, which has endoglucanase activity;

(iii) a glucoamylase comprising, consisting or consisting essentially of a glucoamylase having the amino acid sequence set forth in SEQ ID NO: 126, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the amino acid sequence of SEQ ID NO: 126, which has glucoamylase activity;

(iv) a alpha-amylase comprising, consisting of, or consisting essentially of the amino acid sequence set forth in SEQ ID NO: 128 with the following substitutions: G128D+D143N, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the amino acid sequence of SEQ ID NO: 124, which has alpha-amylase activity; and (v) a trehalase comprising, consisting of, or consisting essentially of the amino acid sequence set forth in SEQ ID NO: 129 or SEQ ID NO: 130, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the amino acid sequence of SEQ ID NO: 129 or 130, which has alpha-amylase activity.

In one embodiment a composition for increasing enzyme accessibility of cellulose fiber in starch-containing material or cellulosic-containing material to cellulolytic degradation comprises:

(i) a pectinolytic composition comprising a polygalacturonase from the GH28 family and a pectin methyl esterase from the CE8 family, wherein the polygalacturonase from the GH28 family comprises, consists of, or consists essentially of the mature polypeptide of SEQ ID NO: 2, or is a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 2 or the full-length polypeptide of SEQ ID NO: 3, which has polygalacturonase activity, and wherein the pectin methyl esterase comprises, consists of, or consists essentially of the mature polypeptide of SEQ ID NO: 65, or is a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 65, or the full-length polypeptide of SEQ ID NO: 66, which has pectin methyl esterase activity;

(ii) a cellulolytic composition derived from *Trichoderma reesei* and comprising a beta-glucosidase comprising, consisting of, or consisting essentially of the mature polypeptide of SEQ ID NO: 110 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 110, which has beta-glucosidase activity, a cellobiohydrolase I comprising, consisting of, or consisting essentially of the mature polypeptide of SEQ ID NO: 111 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 111, which has cellobiohydrolase activity, and an endoglucanase I comprising, consisting of, or consisting essentially of the mature polypeptide of SEQ ID NO: 113 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 113, which has endoglucanase activity;

(iii) a glucoamylase comprising, consisting or consisting essentially of a glucoamylase having the amino acid sequence set forth in SEQ ID NO: 126, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the amino acid sequence of SEQ ID NO: 126, which has glucoamylase activity;

(iv) an alpha-amylase comprising, consisting of, or consisting essentially of the amino acid sequence set forth in SEQ ID NO: 128 with the following substitutions: G128D+D143N, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the amino acid sequence of SEQ ID NO: 124, which has alpha-amylase activity; and (v) a trehalase comprising, consisting of, or consisting essentially of the amino acid sequence set forth in SEQ ID NO: 129 or SEQ ID NO: 130, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the amino acid sequence of SEQ ID NO: 129 or 130, which has alpha-amylase activity.

In one embodiment a composition for increasing enzyme accessibility of cellulose fiber in starch-containing material or cellulosic-containing material to cellulolytic degradation comprises:

(i) a pectinolytic composition comprising a polygalacturonase from the GH28 family and a pectin methyl esterase from the CE8 family, wherein the polygalacturonase from the GH28 family is selected from the group consisting of a polypeptide comprising, consisting of, or consisting essentially of the mature polypeptide of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, or SEQ ID NO: 43, or is a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, or SEQ ID NO: 43, or the full-length polypeptide of SEQ ID NO: 3, SEQ ID NO: 6, SEQ ID NO: 9, SEQ ID NO: 12, SEQ ID NO: 15, SEQ ID NO: 18, SEQ ID NO: 21, SEQ ID NO: 24, SEQ ID NO: 27, SEQ ID NO: 30, SEQ ID NO: 33, SEQ ID NO: 36, SEQ ID NO: 39, SEQ ID NO: 42, or SEQ ID NO: 45, which has polygalacturonase activity, and wherein the pectin methyl esterase is selected from the group consisting of the mature polypeptide of SEQ ID NO: 65, SEQ ID NO: 68, SEQ ID NO: 71, and SEQ ID NO: 74, or is a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 65, SEQ ID NO: 68, SEQ ID NO: 71, and SEQ ID NO: 74, or the full-length polypeptide of SEQ ID NO: 66, SEQ ID NO: 69, SEQ ID NO: 72, and SEQ ID NO: 75, which has pectin methyl esterase activity;

(ii) a cellulolytic composition derived from *Trichoderma reesei* and comprising a GH61 polypeptide having cellulolytic enhancing activity comprising, consisting of, or consisting essentially of the mature polypeptide of SEQ ID NO: 109 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 109, which has cellulolytic enhancing activity, a beta-glucosidase comprising, consisting of, or consisting essentially of the mature polypeptide of SEQ ID NO: 110 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 110, which has beta-glucosidase activity, a cellobiohydrolase I comprising, consisting of, or consisting essentially of the mature polypeptide of SEQ ID NO: 111 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 111, which has cellobiohydrolase activity, a cellobiohydrolase II comprising, consisting of, or consisting essentially of the mature polypeptide of SEQ ID NO: 112 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 112, which has cellobiohydrolase activity, and an endoglucanase I comprising, consisting of, or consisting essentially of the mature polypeptide of SEQ ID NO: 113 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 113, which has endoglucanase activity;

(iii) a glucoamylase blend comprising, consisting or consisting essentially of a first glucoamylase having the amino acid sequence set forth in SEQ ID NO: 123, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the amino acid sequence of SEQ ID NO: 123, which has glucoamylase activity, and a second glucoamylase having the amino acid sequence set forth in SEQ ID NO: 124, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the amino acid sequence of SEQ ID NO: 124, which has glucoamylase activity;

(iv) a alpha-amylase comprising, consisting of, or consisting essentially of the amino acid sequence set forth in SEQ ID NO: 128 with the following substitutions: G128D+D143N, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the amino acid sequence of SEQ ID NO: 124, which has alpha-amylase activity; and (v) an optional trehalase.

In one embodiment a composition for increasing enzyme accessibility of cellulose fiber in starch-containing material or cellulosic-containing material to cellulolytic degradation comprises:

(i) a pectinolytic composition comprising a polygalacturonase from the GH28 family and a pectin methyl esterase from the CE8 family, wherein the polygalacturonase from the GH28 family comprises, consists of, or consists essentially of the mature polypeptide of SEQ ID NO: 2, or is a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 2 or the full-length polypeptide of SEQ ID NO: 3, which has polygalacturonase activity, and wherein the pectin methyl esterase comprises, consists of, or consists essentially of the mature polypeptide of SEQ ID NO: 65, or is a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 65, or the full-length polypeptide of SEQ ID NO: 66, which has pectin methyl esterase activity;

(ii) a cellulolytic composition derived from *Trichoderma reesei* and comprising a GH61 polypeptide having cellulolytic enhancing activity comprising, consisting of, or consisting essentially of the mature polypeptide of SEQ ID NO: 109 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 109, which has cellulolytic enhancing activity, a beta-glucosidase comprising, consisting of, or consisting essentially of the mature polypeptide of SEQ ID NO: 110 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 110, which has beta-glucosidase activity, a cellobiohydrolase I comprising, consisting of, or consisting essentially of the mature polypeptide of SEQ ID NO: 111 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 111, which has cellobiohydrolase activity, a cellobiohydrolase II comprising, consisting of, or consisting essentially of the mature polypeptide of SEQ ID NO: 112 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 112, which has cellobiohydrolase activity, and an endoglucanase I comprising, consisting of, or consisting essentially of the mature polypeptide of SEQ ID NO: 113 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 113, which has endoglucanase activity;

(iii) a glucoamylase blend comprising, consisting or consisting essentially of a first glucoamylase having the amino acid sequence set forth in SEQ ID NO: 123, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the amino acid sequence of SEQ ID NO: 123, which has glucoamylase activity, and a second glucoamylase having the amino acid sequence set forth in SEQ ID NO: 124, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the amino acid sequence of SEQ ID NO: 124, which has glucoamylase activity;

(iv) an alpha-amylase comprising, consisting of, or consisting essentially of the amino acid sequence set forth in SEQ ID NO: 128 with the following substitutions: G128D+D143N, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the amino acid sequence of SEQ ID NO: 124, which has alpha-amylase activity; and (v) an optional trehalase.

In one embodiment a composition for increasing enzyme accessibility of cellulose fiber in starch-containing material or cellulosic-containing material to cellulolytic degradation comprises:

(i) a pectinolytic composition comprising a polygalacturonase from the GH28 family and a pectin methyl esterase from the CE8 family, wherein the polygalacturonase from the GH28 family is selected from the group consisting of a polypeptide comprising, consisting of, or consisting essentially of the mature polypeptide of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, or SEQ ID NO: 43, or is a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, or SEQ ID NO: 43, or the full-length polypeptide of SEQ ID NO: 3, SEQ ID NO: 6, SEQ ID NO: 9, SEQ ID NO: 12, SEQ ID NO: 15, SEQ ID NO: 18, SEQ ID NO: 21, SEQ ID NO: 24, SEQ ID NO: 27, SEQ ID NO: 30, SEQ ID NO: 33, SEQ ID NO: 36, SEQ ID NO: 39, SEQ ID NO: 42, or SEQ ID NO: 45, which has polygalacturonase activity, and wherein the pectin methyl esterase is selected from the group consisting of the mature polypeptide of SEQ ID NO: 65, SEQ ID NO: 68, SEQ ID NO: 71, and SEQ ID NO: 74, or is a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 65, SEQ ID NO: 68, SEQ ID NO: 71, and SEQ ID NO: 74, or the full-length polypeptide of SEQ ID NO: 66, SEQ ID NO: 69, SEQ ID NO: 72, and SEQ ID NO: 75, which has pectin methyl esterase activity;

(ii) a cellulolytic composition derived from *Trichoderma reesei* and comprising a GH61 polypeptide having cellulolytic enhancing activity comprising, consisting of, or consisting essentially of the mature polypeptide of SEQ ID NO: 109 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 109, which has cellulolytic enhancing activity, a beta-glucosidase comprising, consisting of, or consisting essentially of the mature polypeptide of SEQ ID NO: 110 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 110, which has beta-glucosidase activity, a cellobiohydrolase I comprising, consisting of, or consisting essentially of the mature polypeptide of SEQ ID NO: 111 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 111, which has cellobiohydrolase activity, a cellobiohydrolase II comprising, consisting of, or consisting essentially of the mature polypeptide of SEQ ID NO: 112 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 112, which has cellobiohydrolase activity, and an endoglucanase I comprising, consisting of, or consisting essentially of the mature polypeptide of SEQ ID NO: 113 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 113, which has endoglucanase activity;

(iii) a glucoamylase comprising, consisting or consisting essentially of a glucoamylase having the amino acid sequence set forth in SEQ ID NO: 126, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the amino acid sequence of SEQ ID NO: 126, which has glucoamylase activity; (iv) a alpha-amylase comprising, consisting of, or consisting essentially of the amino acid sequence set forth in SEQ ID NO: 128 with the following substitutions: G128D+D143N, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the amino acid sequence of SEQ ID NO: 124, which has alpha-amylase activity; and (v) a trehalase comprising, consisting of, or consisting essentially of the amino acid sequence set forth in SEQ ID NO: 129 or SEQ ID NO: 130, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the amino acid sequence of SEQ ID NO: 129 or 130, which has alpha-amylase activity.

In one embodiment a composition for increasing enzyme accessibility of cellulose fiber in starch-containing material or cellulosic-containing material to cellulolytic degradation comprises:

(i) a pectinolytic composition comprising a polygalacturonase from the GH28 family and a pectin methyl esterase from the CE8 family, wherein the polygalacturonase from the GH28 family comprises, consists of, or consists essentially of the mature polypeptide of SEQ ID NO: 2, or is a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 2 or the full-length polypeptide of SEQ ID NO: 3, which has polygalacturonase activity, and wherein the pectin methyl esterase comprises, consists of, or consists essentially of the mature polypeptide of SEQ ID NO: 65, or is a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 65, or the full-length polypeptide of SEQ ID NO: 66, which has pectin methyl esterase activity;

(ii) a cellulolytic composition derived from *Trichoderma reesei* and comprising a GH61 polypeptide having cellulolytic enhancing activity comprising, consisting of, or consisting essentially of the mature polypeptide of SEQ ID NO: 109 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 109, which has cellulolytic enhancing activity, a beta-glucosidase comprising, consisting of, or consisting essentially of the mature polypeptide of SEQ ID NO: 110 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 110, which has beta-glucosidase activity, a cellobiohydrolase I comprising, consisting of, or consisting essentially of the mature polypeptide of SEQ ID NO: 111 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 111, which has cellobiohydrolase activity, a cellobiohydrolase II comprising, consisting of, or consisting essentially of the mature polypeptide of SEQ ID NO: 112 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 112, which has cellobiohydrolase activity, and an endoglucanase I comprising, consisting of, or consisting essentially of the mature polypeptide of SEQ ID NO: 113 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 113, which has endoglucanase activity;

(iii) a glucoamylase comprising, consisting or consisting essentially of a glucoamylase having the amino acid sequence set forth in SEQ ID NO: 126, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the amino acid sequence of SEQ ID NO: 126, which has glucoamylase activity; (iv) an alpha-amylase comprising, consisting of, or consisting essentially of the amino acid sequence set forth in SEQ ID NO: 128 with the following substitutions: G128D+D143N, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the amino acid sequence of SEQ ID NO: 124, which has alpha-amylase activity; and (v) a trehalase comprising, consisting of, or consisting essentially of the amino acid sequence set forth in SEQ ID NO: 129 or SEQ ID NO: 130, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the amino acid sequence of SEQ ID NO: 129 or 130, which has alpha-amylase activity.

In any of the above embodiments pertaining to compositions for increasing enzyme accessibility of cellulose fiber in starch-containing material or cellulosic-containing material to cellulolytic degradation, the pectinolytic composition (i) may further comprise a pectin lyase from the PL1_4 family, wherein the pectin lyase from the PL1_4 family is selected from the group consisting of a polypeptide comprising, consisting of, or consisting essentially of the mature polypeptide of SEQ ID NO: 2, SEQ ID NO: 77, SEQ ID NO: 80, SEQ ID NO: 107, and a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 77, SEQ ID NO: 80, or SEQ ID NO: 107, or the full-length polypeptide of SEQ ID NO: 78, SEQ ID NO: 81, and SEQ ID NO: 108, which has pectin lyase activity.

In one embodiment a composition for increasing enzyme accessibility of cellulose fiber in starch-containing material or cellulosic-containing material to cellulolytic degradation comprises:

(i) a pectinolytic composition comprising a pectin lyase from the PL1_4 family;

(ii) a cellulolytic composition comprising a beta-glucosidase, a cellobiohydrolase I, and an endoglucanase I;

(iii) an optional glucoamylase;

(iv) an optional alpha-amylase; and (v) an optional trehalase.

In one embodiment a composition for increasing enzyme accessibility of cellulose fiber in starch-containing material or cellulosic-containing material to cellulolytic degradation comprises:

(i) a pectinolytic composition comprising a pectin lyase from the PL1_4 family;

(ii) a cellulolytic composition comprising an *Aspergillus* beta-glucosidase, an *Aspergillus* cellobiohydrolase I, and a *Trichoderma* endoglucanase I;

(iii) an optional glucoamylase;

(iv) an optional alpha-amylase; and (v) an optional trehalase.

In one embodiment a composition for increasing enzyme accessibility of cellulose fiber in starch-containing material or cellulosic-containing material to cellulolytic degradation comprises:

(i) a pectinolytic composition comprising a pectin lyase from the PL1_4 family;

(ii) a cellulolytic composition comprising an *Aspergillus fumigatus* beta-glucosidase, an *Aspergillus fumigatus* cellobiohydrolase I, and a *Trichoderma reesei* endoglucanase I;

(iii) an optional glucoamylase;

(iv) an optional alpha-amylase; and (v) an optional trehalase.

In one embodiment a composition for increasing enzyme accessibility of cellulose fiber in starch-containing material or cellulosic-containing material to cellulolytic degradation comprises:

(i) a pectinolytic composition comprising a pectin lyase from the PL1_4 family;

(ii) a cellulolytic composition derived from *Trichoderma reesei, Humicola insulens*, or *Chrysosporium lucknowense* and comprising an *Aspergillus fumigatus* beta-glucosidase, an *Aspergillus fumigatus* cellobiohydrolase I, and a *Trichoderma reesei* endoglucanase I;

(iii) an optional glucoamylase;

(iv) an optional alpha-amylase; and (v) an optional trehalase.

In one embodiment a composition for increasing enzyme accessibility of cellulose fiber in starch-containing material or cellulosic-containing material to cellulolytic degradation comprises:

(i) a pectinolytic composition comprising a pectin lyase from the PL1_4 family, wherein the pectin lyase from the PL_4 family is selected from the group consisting of a polypeptide comprising, consisting of, or consisting essentially of the mature polypeptide of SEQ ID NO: 2, SEQ ID NO: 77, SEQ ID NO: 80, SEQ ID NO: 107, and a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 77, SEQ ID NO: 80, or SEQ ID NO: 107, or the full-length polypeptide of SEQ ID NO: 78, SEQ ID NO: 81, and SEQ ID NO: 108, which has pectin lyase activity;

(ii) a cellulolytic composition derived from *Trichoderma reesei, Humicola insulens*, or *Chrysosporium lucknowense* and comprising an *Aspergillus fumigatus* beta-glucosidase, an *Aspergillus fumigatus* cellobiohydrolase I, and a *Trichoderma reesei* endoglucanase I;

(iii) an optional glucoamylase;

(iv) an optional alpha-amylase; and (v) an optional trehalase.

In one embodiment a composition for increasing enzyme accessibility of cellulose fiber in starch-containing material or cellulosic-containing material to cellulolytic degradation comprises:

(i) a pectinolytic composition comprising a pectin lyase from the PL1_4 family, wherein the pectin lyase from the PL1_4 family is selected from the group consisting of a polypeptide comprising, consisting of, or consisting essentially of the mature polypeptide of SEQ ID NO: 2, SEQ ID NO: 77, SEQ ID NO: 80, SEQ ID NO: 107, and a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 77, SEQ ID NO: 80, or SEQ ID NO: 107, or the full-length polypeptide of SEQ ID NO: 78, SEQ ID NO: 81, and SEQ ID NO: 108, which has pectin lyase activity;

(ii) a cellulolytic composition derived from *Trichoderma reesei* and comprising a beta-glucosidase comprising, consisting of, or consisting essentially of the mature polypeptide of SEQ ID NO: 110 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 110, which has beta-glucosidase activity, a cellobiohydrolase I comprising, consisting of, or consisting essentially of the mature polypeptide of SEQ ID NO: 111 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 111, which has cellobiohydrolase activity, and an endoglucanase I comprising, consisting of, or consisting essentially of the mature polypeptide of SEQ ID NO: 113 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 113, which has endoglucanase activity;

(iii) an optional glucoamylase;

(iv) an optional alpha-amylase; and (v) an optional trehalase.

In one embodiment a composition for increasing enzyme accessibility of cellulose fiber in starch-containing material or cellulosic-containing material to cellulolytic degradation comprises:

(i) a pectinolytic composition comprising a pectin lyase from the PL1_4 family, wherein the pectin lyase from the PL1_4 family is selected from the group consisting of a polypeptide comprising, consisting of, or consisting essentially of the mature polypeptide of SEQ ID NO: 2, SEQ ID NO: 77, SEQ ID NO: 80, SEQ ID NO: 107, and a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 77, SEQ ID NO: 80, or SEQ ID NO: 107, or the full-length polypeptide of SEQ ID NO: 78, SEQ ID NO: 81, and SEQ ID NO: 108, which has pectin lyase activity;

(ii) a cellulolytic composition derived from *Trichoderma reesei* and comprising a beta-glucosidase comprising, consisting of, or consisting essentially of the mature polypeptide of SEQ ID NO: 110 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 110, which has beta-glucosidase activity, a cellobiohydrolase I comprising, consisting of, or consisting essentially of the mature polypeptide of SEQ ID NO: 111 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 111, which has cellobiohydrolase activity, and an endoglucanase I comprising, consisting of, or consisting essentially of the mature polypeptide of SEQ ID NO: 113 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 113, which has endoglucanase activity;

(iii) an optional glucoamylase;

(iv) an optional alpha-amylase; and (v) an optional trehalase.

In one embodiment a composition for increasing enzyme accessibility of cellulose fiber in starch-containing material or cellulosic-containing material to cellulolytic degradation comprises:

(i) a pectinolytic composition comprising a pectin lyase from the PL1_4 family;

(ii) a cellulolytic composition comprising a beta-glucosidase, a cellobiohydrolase I, a cellobiohydrolase II, a GH61 polypeptide having cellulolytic enhancing activity, and an endoglucanase I;

(iii) an optional glucoamylase;

(iv) an optional alpha-amylase; and (v) an optional trehalase.

In one embodiment a composition for increasing enzyme accessibility of cellulose fiber in starch-containing material or cellulosic-containing material to cellulolytic degradation comprises:

(i) a pectinolytic composition comprising a pectin lyase from the PL1_4 family;

(ii) a cellulolytic composition comprising an *Aspergillus* beta-glucosidase, an *Aspergillus* cellobiohydrolase I, an *Aspergillus* cellobiohydrolase II, a *Penicillium* GH61 polypeptide having cellulolytic enhancing activity, and a *Trichoderma* endoglucanase I;

(iii) an optional glucoamylase;

(iv) an optional alpha-amylase; and (v) an optional trehalase.

In one embodiment a composition for increasing enzyme accessibility of cellulose fiber in starch-containing material or cellulosic-containing material to cellulolytic degradation comprises:

(i) a pectinolytic composition comprising a pectin lyase from the PL1_4 family;

(ii) a cellulolytic composition comprising an *Aspergillus fumigatus* beta-glucosidase, an *Aspergillus fumigatus* cellobiohydrolase I, an *Aspergillus fumigatus* cellobiohydrolase II, a *Penicillium emersonii* GH61 polypeptide having cellulolytic enhancing activity, and a *Trichoderma reesei* endoglucanase I;

(iii) an optional glucoamylase;

(iv) an optional alpha-amylase; and (v) an optional trehalase.

In one embodiment a composition for increasing enzyme accessibility of cellulose fiber in starch-containing material or cellulosic-containing material to cellulolytic degradation comprises:

(i) a pectinolytic composition comprising a pectin lyase from the PL1_4 family;

(ii) a cellulolytic composition derived from *Trichoderma reesei, Humicola insulens*, or *Chrysosporium lucknowense* and comprising an *Aspergillus fumigatus* beta-glucosidase, an *Aspergillus fumigatus* cellobiohydrolase I, an *Aspergillus fumigatus* cellobiohydrolase II, a *Penicillium emersonii* GH61 polypeptide having cellulolytic enhancing activity, and a *Trichoderma reesei* endoglucanase I;

(iii) an optional glucoamylase;

(iv) an optional alpha-amylase; and (v) an optional trehalase.

In one embodiment a composition for increasing enzyme accessibility of cellulose fiber in starch-containing material or cellulosic-containing material to cellulolytic degradation comprises:

(i) a pectinolytic composition comprising a pectin lyase from the PL1_4 family, wherein the pectin lyase from the PL1_4 family is selected from the group consisting of a polypeptide comprising, consisting of, or consisting essentially of the mature polypeptide of SEQ ID NO: 2, SEQ ID NO: 77, SEQ ID NO: 80, SEQ ID NO: 107, and a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 77, SEQ ID NO: 80, or SEQ ID NO: 107, or the full-length polypeptide of SEQ ID NO: 78, SEQ ID NO: 81, and SEQ ID NO: 108, which has pectin lyase activity;

(ii) a cellulolytic composition derived from *Trichoderma reesei, Humicola insulens*, or *Chrysosporium lucknowense* and comprising an *Aspergillus fumigatus* beta-glucosidase, an *Aspergillus fumigatus* cellobiohydrolase I, an *Aspergillus fumigatus* cellobiohydrolase II, a *Penicillium emersonii* GH61 polypeptide having cellulolytic enhancing activity, and a *Trichoderma reesei* endoglucanase I;

(iii) an optional glucoamylase;

(iv) an optional alpha-amylase; and (v) an optional trehalase.

In one embodiment a composition for increasing enzyme accessibility of cellulose fiber in starch-containing material or cellulosic-containing material to cellulolytic degradation comprises:

(i) a pectinolytic composition comprising a polygalacturonase from the GH28 family and a pectin methyl esterase from the CE8 family, wherein the polygalacturonase from the GH28 family is selected from the group consisting of a polypeptide comprising, consisting of, or consisting essentially of the mature polypeptide of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, or SEQ ID NO: 44, or is a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, or SEQ ID NO: 44, or the full-length polypeptide of SEQ ID NO: 3, SEQ ID NO: 6, SEQ ID NO: 9, SEQ ID NO: 12, SEQ ID NO: 15, SEQ ID NO: 18, SEQ ID NO: 21, SEQ ID NO: 24, SEQ ID NO: 27, SEQ ID NO: 30, SEQ ID NO: 33, SEQ ID NO: 36, SEQ ID NO: 39, SEQ ID NO: 42, or SEQ ID NO: 45, which has polygalacturonase activity, and wherein the pectin methyl esterase is selected from the group consisting of the mature polypeptide of SEQ ID NO: 65, SEQ ID NO: 68, SEQ ID NO: 71, and SEQ ID NO: 74, or is a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 65, SEQ ID NO: 68, SEQ ID NO: 71, and SEQ ID NO: 74, or the full-length polypeptide of SEQ ID NO: 66, SEQ ID NO: 69, SEQ ID NO: 72, and SEQ ID NO: 75, which has pectin methyl esterase activity;

(ii) a cellulolytic composition derived from *Trichoderma reesei* and comprising a GH61 polypeptide having cellulolytic enhancing activity comprising, consisting of, or consisting essentially of the mature polypeptide of SEQ ID NO: 109, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 109, which has cellulolytic enhancing activity, a beta-glucosidase comprising, consisting of, or consisting essentially of the mature polypeptide of SEQ ID NO: 110 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 110, which has beta-glucosidase activity, a cellobiohydrolase I comprising, consisting of, or consisting essentially of the mature polypeptide of SEQ ID NO: 111 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 111, which has cellobiohydrolase activity, a cellobiohydrolase II comprising, consisting of, or consisting essentially of the mature polypeptide of SEQ ID NO: 112 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 112, which has cellobiohydrolase activity and an endoglucanase I comprising, consisting of, or consisting essentially of the mature polypeptide of SEQ ID NO: 113 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 113, which has endoglucanase activity;

(iii) an optional glucoamylase;

(iv) an optional alpha-amylase; and (v) an optional trehalase.

In one embodiment a composition for increasing enzyme accessibility of cellulose fiber in starch-containing material or cellulosic-containing material to cellulolytic degradation comprises:

(i) a pectinolytic composition comprising a pectin lyase from the PL1_4 family, wherein the pectin lyase from the PL1_4 family is selected from the group consisting of a polypeptide comprising, consisting of, or consisting essentially of the mature polypeptide of SEQ ID NO: 2, SEQ ID NO: 77, SEQ ID NO: 80, SEQ ID NO: 107, and a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 77, SEQ ID NO: 80, or SEQ ID NO: 107, or the full-length polypeptide of SEQ ID NO: 78, SEQ ID NO: 81, and SEQ ID NO: 108, which has pectin lyase activity;

(ii) a cellulolytic composition derived from *Trichoderma reesei* and comprising a beta-glucosidase comprising, consisting of, or consisting essentially of the mature polypeptide of SEQ ID NO: 110 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 110, which has beta-glucosidase activity, a cellobiohydrolase I comprising, consisting of, or consisting essentially of the mature polypeptide of SEQ ID NO: 111 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 111, which has cellobiohydrolase activity, and an endoglucanase I comprising, consisting of, or consisting essentially of the mature polypeptide of SEQ ID NO: 113 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 113, which has endoglucanase activity;

(iii) a glucoamylase blend comprising, consisting or consisting essentially of a first glucoamylase having the amino acid sequence set forth in SEQ ID NO: 123, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the amino acid sequence of SEQ ID NO: 123, which has glucoamylase activity, and a second glucoamylase having the amino acid sequence set forth in SEQ ID NO: 124, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the amino acid sequence of SEQ ID NO: 124, which has glucoamylase activity;

(iv) a alpha-amylase comprising, consisting of, or consisting essentially of the amino acid sequence set forth in SEQ ID NO: 128 with the following substitutions: G128D+D143N, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the amino acid sequence of SEQ ID NO: 124, which has alpha-amylase activity; and (v) an optional trehalase.

In one embodiment a composition for increasing enzyme accessibility of cellulose fiber in starch-containing material or cellulosic-containing material to cellulolytic degradation comprises:

(i) a pectinolytic composition comprising a pectin lyase from the PL1_4 family, wherein the pectin lyase from the PL1_4 family comprises, consists of, or consists essentially of the mature polypeptide of SEQ ID NO: 107, or is a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 107, or the full-length polypeptide of SEQ ID NO: 108, which has pectin lyase activity;

(ii) a cellulolytic composition derived from *Trichoderma reesei* and comprising a beta-glucosidase comprising, consisting of, or consisting essentially of the mature polypeptide of SEQ ID NO: 110 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 110, which has beta-glucosidase activity, a cellobiohydrolase I comprising, consisting of, or consisting essentially of the mature polypeptide of SEQ ID NO: 111 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 111, which has cellobiohydrolase activity, and an endoglucanase I comprising, consisting of, or consisting essentially of the mature polypeptide of SEQ ID NO: 113 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 113, which has endoglucanase activity;

(iii) a glucoamylase blend comprising, consisting or consisting essentially of a first glucoamylase having the amino acid sequence set forth in SEQ ID NO: 123, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the amino acid sequence of SEQ ID NO: 123, which has glucoamylase activity, and a second glucoamylase having the amino acid sequence set forth in SEQ ID NO: 124, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the amino acid sequence of SEQ ID NO: 124, which has glucoamylase activity;

(iv) an alpha-amylase comprising, consisting of, or consisting essentially of the amino acid sequence set forth in SEQ ID NO: 128 with the following substitutions: G128D+D143N, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the amino acid sequence of SEQ ID NO: 124, which has alpha-amylase activity; and (v) an optional trehalase.

In one embodiment a composition for increasing enzyme accessibility of cellulose fiber in starch-containing material or cellulosic-containing material to cellulolytic degradation comprises:

(i) a pectinolytic composition comprising a pectin lyase from the PL1_4 family, wherein the pectin lyase from the PL1_4 family is selected from the group consisting of a polypeptide comprising, consisting of, or consisting essentially of the mature polypeptide of SEQ ID NO: 2, SEQ ID NO: 77, SEQ ID NO: 80, SEQ ID NO: 107, and a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 77, SEQ ID NO: 80, or SEQ ID NO: 107, or the full-length polypeptide of SEQ ID NO: 78, SEQ ID NO: 81, and SEQ ID NO: 108, which has pectin lyase activity;

(ii) a cellulolytic composition derived from *Trichoderma reesei* and comprising a beta-glucosidase comprising, consisting of, or consisting essentially of the mature polypeptide of SEQ ID NO: 110 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 110, which has beta-glucosidase activity, a cellobiohydrolase I comprising, consisting of, or consisting essentially of the mature polypeptide of SEQ ID NO: 111 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 111, which has cellobiohydrolase activity, and an endoglucanase I comprising, consisting of, or consisting essentially of the mature polypeptide of SEQ ID NO: 113 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 113, which has endoglucanase activity;

(iii) a glucoamylase comprising, consisting or consisting essentially of a glucoamylase having the amino acid sequence set forth in SEQ ID NO: 126, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the amino acid sequence of SEQ ID NO: 126, which has glucoamylase activity;

(iv) a alpha-amylase comprising, consisting of, or consisting essentially of the amino acid sequence set forth in SEQ ID NO: 128 with the following substitutions: G128D+D143N, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the amino acid sequence of SEQ ID NO: 124, which has alpha-amylase activity; and (v) a trehalase comprising, consisting of, or consisting essentially of the amino acid sequence set forth in SEQ ID NO: 129 or SEQ ID NO: 130, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the amino acid sequence of SEQ ID NO: 129 or 130, which has alpha-amylase activity.

In one embodiment a composition for increasing enzyme accessibility of cellulose fiber in starch-containing material or cellulosic-containing material to cellulolytic degradation comprises:

(i) a pectinolytic composition comprising a pectin lyase from the PL1_4 family, wherein the pectin lyase from the PL1_4 family comprises, consists of, or consists essentially of the mature polypeptide of SEQ ID NO: 107, or is a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 107, or the full-length polypeptide of SEQ ID NO: 108, which has pectin lyase activity;

(ii) a cellulolytic composition derived from *Trichoderma reesei* and comprising a beta-glucosidase comprising, consisting of, or consisting essentially of the mature polypeptide of SEQ ID NO: 110 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 110, which has beta-glucosidase activity, a cellobiohydrolase I comprising, consisting of, or consisting essentially of the mature polypeptide of SEQ ID NO: 111 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 111, which has cellobiohydrolase activity, and an endoglucanase I comprising, consisting of, or consisting essentially of the mature polypeptide of SEQ ID NO: 113 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 113, which has endoglucanase activity;

(iii) a glucoamylase comprising, consisting or consisting essentially of a glucoamylase having the amino acid sequence set forth in SEQ ID NO: 126, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the amino acid sequence of SEQ ID NO: 126, which has glucoamylase activity;

(iv) an alpha-amylase comprising, consisting of, or consisting essentially of the amino acid sequence set forth in SEQ ID NO: 128 with the following substitutions: G128D+D143N, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the amino acid sequence of SEQ ID NO: 124, which has alpha-amylase activity; and (v) a trehalase comprising, consisting of, or consisting essentially of the amino acid sequence set forth in SEQ ID NO: 129 or SEQ ID NO: 130, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the amino acid sequence of SEQ ID NO: 129 or 130, which has alpha-amylase activity.

In one embodiment a composition for increasing enzyme accessibility of cellulose fiber in starch-containing material or cellulosic-containing material to cellulolytic degradation comprises:

(i) a pectinolytic composition comprising a pectin lyase from the PL1_4 family, wherein the pectin lyase from the PL1_4 family is selected from the group consisting of a polypeptide comprising, consisting of, or consisting essentially of the mature polypeptide of SEQ ID NO: 77, SEQ ID NO: 80, SEQ ID NO: 107, and a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 77, SEQ ID NO: 80, or SEQ ID NO: 107, or the full-length polypeptide of SEQ ID NO: 78, SEQ ID NO: 81, and SEQ ID NO: 108, which has pectin lyase activity;

(ii) a cellulolytic composition derived from *Trichoderma reesei* and comprising a GH61 polypeptide having cellulolytic enhancing activity comprising, consisting of, or consisting essentially of the mature polypeptide of SEQ ID NO: 109 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 109, which has cellulolytic enhancing activity, a beta-glucosidase comprising, consisting of, or consisting essentially of the mature polypeptide of SEQ ID NO: 110 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 110, which has beta-glucosidase activity, a cellobiohydrolase I comprising, consisting of, or consisting essentially of the mature polypeptide of SEQ ID NO: 111 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 111, which has cellobiohydrolase activity, a cellobiohydrolase II comprising, consisting of, or consisting essentially of the mature polypeptide of SEQ ID NO: 112 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 112, which has cellobiohydrolase activity, and an endoglucanase I comprising, consisting of, or consisting essentially of the mature polypeptide of SEQ ID NO: 113 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 113, which has endoglucanase activity;

(iii) a glucoamylase blend comprising, consisting or consisting essentially of a first glucoamylase having the amino acid sequence set forth in SEQ ID NO: 123, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the amino acid sequence of SEQ ID NO: 123, which has glucoamylase activity, and a second glucoamylase having the amino acid sequence set forth in SEQ ID NO: 124, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the amino acid sequence of SEQ ID NO: 124, which has glucoamylase activity;

(iv) a alpha-amylase comprising, consisting of, or consisting essentially of the amino acid sequence set forth in SEQ ID NO: 128 with the following substitutions: G128D+D143N, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the amino acid sequence of SEQ ID NO: 124, which has alpha-amylase activity; and (v) an optional trehalase.

In one embodiment a composition for increasing enzyme accessibility of cellulose fiber in starch-containing material or cellulosic-containing material to cellulolytic degradation comprises:

(i) a pectinolytic composition comprising a pectin lyase from the PL1_4 family, wherein the pectin lyase from the PL1_4 family comprises, consists of, or consists essentially of the mature polypeptide of SEQ ID NO: 107, or is a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 107, or the full-length polypeptide of SEQ ID NO: 108, which has pectin lyase activity;

(ii) a cellulolytic composition derived from *Trichoderma reesei* and comprising a GH61 polypeptide having cellulolytic enhancing activity comprising, consisting of, or consisting essentially of the mature polypeptide of SEQ ID NO: 109 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 109, which has cellulolytic enhancing activity, a beta-glucosidase comprising, consisting of, or consisting essentially of the mature polypeptide of SEQ ID NO: 110 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 110, which has beta-glucosidase activity, a cellobiohydrolase I comprising, consisting of, or consisting essentially of the mature polypeptide of SEQ ID NO: 111 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 111, which has cellobiohydrolase activity, a cellobiohydrolase II comprising, consisting of, or consisting essentially of the mature polypeptide of SEQ ID NO: 112 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 112, which has cellobiohydrolase activity, and an endoglucanase I comprising, consisting of, or consisting essentially of the mature polypeptide of SEQ ID NO: 113 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 113, which has endoglucanase activity;

(iii) a glucoamylase blend comprising, consisting or consisting essentially of a first glucoamylase having the amino acid sequence set forth in SEQ ID NO: 123, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the amino acid sequence of SEQ ID NO: 123, which has glucoamylase activity, and a second glucoamylase having the amino acid sequence set forth in SEQ ID NO: 124, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the amino acid sequence of SEQ ID NO: 124, which has glucoamylase activity;

(iv) an alpha-amylase comprising, consisting of, or consisting essentially of the amino acid sequence set forth in SEQ ID NO: 128 with the following substitutions: G128D+D143N, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the amino acid sequence of SEQ ID NO: 124, which has alpha-amylase activity; and (v) an optional trehalase.

In one embodiment a composition for increasing enzyme accessibility of cellulose fiber in starch-containing material or cellulosic-containing material to cellulolytic degradation comprises:

(i) a pectinolytic composition comprising a pectin lyase from the PL1_4 family, wherein the pectin lyase from the PL1_4 family is selected from the group consisting of a polypeptide comprising, consisting of, or consisting essentially of the mature polypeptide of SEQ ID NO: 77, SEQ ID NO: 80, SEQ ID NO: 107, and a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 77, SEQ ID NO: 80, or SEQ ID NO: 107, or the full-length polypeptide of SEQ ID NO: 78, SEQ ID NO: 81, and SEQ ID NO: 108, which has pectin lyase activity;

(ii) a cellulolytic composition derived from *Trichoderma reesei* and comprising a GH61 polypeptide having cellulolytic enhancing activity comprising, consisting of, or consisting essentially of the mature polypeptide of SEQ ID NO: 109 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 109, which has cellulolytic enhancing activity, a beta-glucosidase comprising, consisting of, or consisting essentially of the mature polypeptide of SEQ ID NO: 110 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 110, which has beta-glucosidase activity, a cellobiohydrolase I comprising, consisting of, or consisting essentially of the mature polypeptide of SEQ ID NO: 111 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 111, which has cellobiohydrolase activity, a cellobiohydrolase II comprising, consisting of, or consisting essentially of the mature polypeptide of SEQ ID NO: 112 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 112, which has cellobiohydrolase activity, and an endoglucanase I comprising, consisting of, or consisting essentially of the mature polypeptide of SEQ ID NO: 113 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 113, which has endoglucanase activity;

(iii) a glucoamylase comprising, consisting or consisting essentially of a glucoamylase having the amino acid sequence set forth in SEQ ID NO: 126, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the amino acid sequence of SEQ ID NO: 126, which has glucoamylase activity; (iv) a alpha-amylase comprising, consisting of, or consisting essentially of the amino acid sequence set forth in SEQ ID NO: 128 with the following substitutions: G128D+D143N, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the amino acid sequence of SEQ ID NO: 124, which has alpha-amylase activity; and (v) a trehalase comprising, consisting of, or consisting essentially of the amino acid sequence set forth in SEQ ID NO: 129 or SEQ ID NO: 130, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the amino acid sequence of SEQ ID NO: 129 or 130, which has alpha-amylase activity.

In one embodiment a composition for increasing enzyme accessibility of cellulose fiber in starch-containing material or cellulosic-containing material to cellulolytic degradation comprises:

(i) a pectinolytic composition comprising a pectin lyase from the PL1_4 family, wherein the pectin lyase from the PL1_4 family comprises, consists of, or consists essentially of the mature polypeptide of SEQ ID NO: 107, or is a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 107, or the full-length polypeptide of SEQ ID NO: 108, which has pectin lyase activity;

(ii) a cellulolytic composition derived from *Trichoderma reesei* and comprising a GH61 polypeptide having cellulolytic enhancing activity comprising, consisting of, or consisting essentially of the mature polypeptide of SEQ ID NO: 109 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 109, which has cellulolytic enhancing activity, a beta-glucosidase comprising, consisting of, or consisting essentially of the mature polypeptide of SEQ ID NO: 110 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 110, which has beta-glucosidase activity, a cellobiohydrolase I comprising, consisting of, or consisting essentially of the mature polypeptide of SEQ ID NO: 111 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 111, which has cellobiohydrolase activity, a cellobiohydrolase II comprising, consisting of, or consisting essentially of the mature polypeptide of SEQ ID NO: 112 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 112, which has cellobiohydrolase activity, and an endoglucanase I comprising, consisting of, or consisting essentially of the mature polypeptide of SEQ ID NO: 113 or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 113, which has endoglucanase activity;

(iii) a glucoamylase comprising, consisting or consisting essentially of a glucoamylase having the amino acid sequence set forth in SEQ ID NO: 126, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the amino acid sequence of SEQ ID NO: 126, which has glucoamylase activity; (iv) an alpha-amylase comprising, consisting of, or consisting essentially of the amino acid sequence set forth in SEQ ID NO: 128 with the following substitutions: G128D+D143N, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the amino acid sequence of SEQ ID NO: 124, which has alpha-amylase activity; and (v) a trehalase comprising, consisting of, or consisting essentially of the amino acid sequence set forth in SEQ ID NO: 129 or SEQ ID NO: 130, or a polypeptide comprising, consisting of, or consisting essentially of an amino acid sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the amino acid sequence of SEQ ID NO: 129 or 130, which has alpha-amylase activity.

Those skilled in the art will appreciate that all of the preceding compositions can be used in any of the preceding processes. For example any of the preceding compositions can be used in the above processes for producing fermentation products from un-gelatinized starch-containing materials, processes for producing fermentation products from gelatinized starch-containing materials, and processes for producing fermentation products from cellulosic-containing material.

The compositions may be prepared in accordance with methods known in the art and may be in the form of a liquid or a dry composition. The compositions may be stabilized in accordance with methods known in the art.

Other Enzymes

In one embodiment, a polypeptide having pectinase activity (e.g., polygalacturonase activity, rhamnogalacturonase activity, pectin methyl esterase, pectin lyase activity, pectin acetyl esterase activity, rhamnogalacturonan lyase activity, beta-galactanase activity, etc.) of the invention is combined with one or more enzymes, such as at least two enzymes, more preferred at least three, four or five enzymes. Preferably, the enzymes have different substrate specificity, e.g., proteolytic activity, amylolytic activity, hemicellulytic activity or cellulolytic activity.

The composition may comprise one or more enzymes such as a protease, a glucoamylase, an alpha-amylase, beta-glucosidase, cellobiohydrolase, phytase, endoglucanase, cellulase, trehalase, or xylanase.

In general the properties of the selected enzyme(s) should be compatible with the process conditions, (i.e., pH-optimum, compatibility with other enzymatic and non-enzymatic ingredients, etc.), and the enzyme(s) should be present in effective amounts.

The present invention is further described by the following examples that should not be construed as limiting the scope of the invention.

The invention is further defined by the following numbered paragraphs:

1. An isolated or purified polypeptide having pectinase activity, wherein the polypeptide having pectinase activity is selected from the group consisting of:

(a)

(i) a polypeptide having at least 99.6% identity, at least 99.7% identity, at least 99.8% or at least 99.9% identity to the mature polypeptide of SEQ ID NO: 5 and having pectinase activity;

(ii) a polypeptide having at least 99.6% identity, at least 99.7% identity, at least 99.8% or at least 99.9% identity to the mature polypeptide of SEQ ID NO: 6, which has pectinase activity;

(iii) a polypeptide having at least 99.6% identity, at least 99.7% identity, at least 99.8% or at least 99.9% identity to a mature polypeptide of SEQ ID NO: 5, which has pectinase activity;

(iv) a polypeptide encoded by a polynucleotide that hybridizes under medium, medium-high, or high stringency conditions with the full-length complement of the mature polypeptide coding sequence of SEQ ID NO: 4, which has pectinase activity;

(v) a polypeptide encoded by a polynucleotide having at least 99.6% identity, at least 99.7% identity, at least 99.8% or at least 99.9% identity to the mature polypeptide coding sequence of SEQ ID NO: 4, which has pectinase activity;

(vi) a polypeptide derived from a mature polypeptide of SEQ ID NO: 5 by substitution, deletion or addition of one or several amino acids in the mature polypeptide of SEQ ID NO: 5, which has pectinase activity; and (vii) a fragment of the polypeptide of (i), (ii), (iii), (iv), (v) or (vi) that has pectinase activity;

(b)

(i) a polypeptide having at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 11, which has pectinase activity;

(ii) a polypeptide having at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 12, which has pectinase activity;

(iii) a polypeptide having at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to a mature polypeptide of SEQ ID NO: 11, which has pectinase activity;

(iv) a polypeptide encoded by a polynucleotide that hybridizes under medium, medium-high, or high stringency conditions with the full-length complement of the mature polypeptide coding sequence of SEQ ID NO: 10 or the cDNA sequence thereof, which has pectinase activity;

(v) a polypeptide encoded by a polynucleotide having at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 10 or the cDNA sequence thereof, which has pectinase activity;

(vi) a polypeptide derived from a mature polypeptide of SEQ ID NO: 11 by substitution, deletion or addition of one or several amino acids in the mature polypeptide of SEQ ID NO: 11, pectinase activity; and (vi) a fragment of the polypeptide of (i), (ii), (iii), (iv), (v) or (vi) that has pectinase activity.

(c)

(i) polypeptide having at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 14, which has pectinase activity;

(ii) a polypeptide having at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 15, which has pectinase activity;

(iii) a polypeptide having at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to a mature polypeptide of SEQ ID NO: 14, which has pectinase activity;

(iv) a polypeptide encoded by a polynucleotide that hybridizes under medium, medium-high, or high stringency conditions with the full-length complement of the mature polypeptide coding sequence of SEQ ID NO: 13 or the cDNA sequence thereof, which has pectinase activity;

(v) a polypeptide encoded by a polynucleotide at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 13 or the cDNA sequence thereof, which has pectinase activity;

(vi) a polypeptide derived from a mature polypeptide of SEQ ID NO: 14 by substitution, deletion or addition of one or several amino acids in the mature polypeptide of SEQ ID NO: 14, which has pectinase activity; and (vi) a fragment of the polypeptide of (i), (ii), (iii), (iv), (v) or (vi) that has pectinase activity;

(d)

(i) polypeptide having at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 17, which has pectinase activity;

(ii) a polypeptide having at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 18, which has pectinase activity;

(iii) a polypeptide at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to a mature polypeptide of SEQ ID NO: 17, which has pectinase activity;

(iv) a polypeptide encoded by a polynucleotide that hybridizes under medium, medium-high, or high stringency conditions with the full-length complement of the mature polypeptide coding sequence of SEQ ID NO: 16 or the cDNA sequence thereof, which has pectinase activity;

(v) a polypeptide encoded by a polynucleotide at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 16 or the cDNA sequence thereof, which has pectinase activity;

(vi) a polypeptide derived from a mature polypeptide of SEQ ID NO: 17 by substitution, deletion or addition of one or several amino acids in the mature polypeptide of SEQ ID NO: 17, which has pectinase activity; and (vi) a fragment of the polypeptide of (i), (ii), (iii), (iv), (v) or (vi) that has pectinase activity;

(e)

(i) polypeptide having at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 20, which has pectinase activity;

(ii) a polypeptide having at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 21, which has pectinase activity;

(iii) a polypeptide having at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to a mature polypeptide of SEQ ID NO: 19, which has pectinase activity;

(iv) a polypeptide encoded by a polynucleotide that hybridizes under medium, medium-high, or high stringency conditions with the full-length complement of the mature polypeptide coding sequence of SEQ ID NO: 19 or the cDNA sequence thereof, which has pectinase activity;

(v) a polypeptide encoded by a polynucleotide having at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 19 or the cDNA sequence thereof, which has pectinase activity;

(vi) a polypeptide derived from a mature polypeptide of SEQ ID NO: 20 by substitution, deletion or addition of one or several amino acids in the mature polypeptide of SEQ ID NO: 20, which has pectinase activity; and (vi) a fragment of the polypeptide of (i), (ii), (iii), (iv), (v) or (vi) that has pectinase activity;

(f)

(i) polypeptide having at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 38, which has pectinase activity;

(ii) a polypeptide having at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 39, which has pectinase activity;

(iii) a polypeptide having at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to a mature polypeptide of SEQ ID NO: 38, which has pectinase activity;

(iv) a polypeptide encoded by a polynucleotide that hybridizes under medium, medium-high, or high stringency conditions with the full-length complement of the mature polypeptide coding sequence of SEQ ID NO: 37 or the cDNA sequence thereof, which has pectinase activity;

(v) a polypeptide encoded by a polynucleotide having at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 37 or the cDNA sequence thereof, which has pectinase activity;

(vi) a polypeptide derived from a mature polypeptide of SEQ ID NO: 38 by substitution, deletion or addition of one or several amino acids in the mature polypeptide of SEQ ID NO: 38, which has pectinase activity; and (vi) a fragment of the polypeptide of (i), (ii), (iii), (iv), (v) or (vi) that has pectinase activity;

(g)

(i) polypeptide having at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 41, which has pectinase activity;

(ii) a polypeptide having at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 42, which has pectinase activity;

(iii) a polypeptide having at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to a mature polypeptide of SEQ ID NO: 41, which has pectinase activity;

(iv) a polypeptide encoded by a polynucleotide that hybridizes under medium, medium-high, or high stringency conditions with the full-length complement of the mature polypeptide coding sequence of SEQ ID NO: 40 or the cDNA sequence thereof, which has pectinase activity;

(v) a polypeptide encoded by a polynucleotide having at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 40 or the cDNA sequence thereof, which has pectinase activity;

(vi) a polypeptide derived from a mature polypeptide of SEQ ID NO: 41 by substitution, deletion or addition of one or several amino acids in the mature polypeptide of SEQ ID NO: 41, which has pectinase activity; and (vi) a fragment of the polypeptide of (i), (ii), (iii), (iv), (v) or (vi) that has pectinase activity;

(h)

(i) polypeptide having at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 44, which has pectinase activity;

(ii) a polypeptide having at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 45, which has pectinase activity;

(iii) a polypeptide having at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to a mature polypeptide of SEQ ID NO: 44, which has pectinase activity;

(iv) a polypeptide encoded by a polynucleotide that hybridizes under medium, medium-high, or high stringency conditions with the full-length complement of the mature polypeptide coding sequence of SEQ ID NO: 43 or the cDNA sequence thereof, which has pectinase activity;

(v) a polypeptide encoded by a polynucleotide having at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 43 or the cDNA sequence thereof, which has pectinase activity;

(vi) a polypeptide derived from a mature polypeptide of SEQ ID NO: 44 by substitution, deletion or addition of one or several amino acids in the mature polypeptide of SEQ ID NO: 44, which has pectinase activity; and (vi) a fragment of the polypeptide of (i), (ii), (iii), (iv), (v) or (vi) that has pectinase activity;

(i)

(i) polypeptide having at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 47, which has pectinase activity;

(ii) a polypeptide having at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 48, which has pectinase activity;

(iii) a polypeptide having at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to a mature polypeptide of SEQ ID NO: 47, which has pectinase activity;

(iv) a polypeptide encoded by a polynucleotide that hybridizes under medium, medium-high, or high stringency conditions with the full-length complement of the mature polypeptide coding sequence of SEQ ID NO: 46 or the cDNA sequence thereof, which has pectinase activity;

(v) a polypeptide encoded by a polynucleotide having at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 46 or the cDNA sequence thereof, which has pectinase activity;

(vi) a polypeptide derived from a mature polypeptide of SEQ ID NO: 47 by substitution, deletion or addition of one or several amino acids in the mature polypeptide of SEQ ID NO: 47, which has pectinase activity; and (vi) a fragment of the polypeptide of (i), (ii), (iii), (iv), (v) or (vi) that has pectinase activity;

(j)

(i) polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 53, which has pectinase activity;

(ii) a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 54, which has pectinase activity;

(iii) a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to a mature polypeptide of SEQ ID NO: 53, which has pectinase activity;

(iv) a polypeptide encoded by a polynucleotide that hybridizes under medium, medium-high, or high stringency conditions with the full-length complement of the mature polypeptide coding sequence of SEQ ID NO: 52, which has pectinase activity;

(v) a polypeptide encoded by a polynucleotide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 52, which has pectinase activity;

(vi) a polypeptide derived from a mature polypeptide of SEQ ID NO: 53 by substitution, deletion or addition of one or several amino acids in the mature polypeptide of SEQ ID NO: 53, which has pectinase activity; and (vi) a fragment of the polypeptide of (i), (ii), (iii), (iv), (v) or (vi) that has pectinase activity;

(k)

(i) polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 56, which has pectinase activity;

(ii) a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 57, which has pectinase activity;

(iii) a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to a mature polypeptide of SEQ ID NO: 56 which has pectinase activity;

(iv) a polypeptide encoded by a polynucleotide that hybridizes under medium, medium-high, or high stringency conditions with the full-length complement of the mature polypeptide coding sequence of SEQ ID NO: 55 or the cDNA sequence thereof, which has pectinase activity;

(v) a polypeptide encoded by a polynucleotide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 55 or the cDNA sequence thereof, which has pectinase activity;

(vi) a polypeptide derived from a mature polypeptide of SEQ ID NO: 56 by substitution, deletion or addition of one or several amino acids in the mature polypeptide of SEQ ID NO: 56, which has pectinase activity; and (vi) a fragment of the polypeptide of (i), (ii), (iii), (iv), (v) or (vi) that has pectinase activity;

(l)

(i) polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 59, which has pectinase activity;

(ii) a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 60, which has pectinase activity;

(iii) a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to a mature polypeptide of SEQ ID NO: 59, which has pectinase activity;

(iv) a polypeptide encoded by a polynucleotide that hybridizes under medium, medium-high, or high stringency conditions with the full-length complement of the mature polypeptide coding sequence of SEQ ID NO: 58 or the cDNA sequence thereof, which has pectinase activity;

(v) a polypeptide encoded by a polynucleotide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 58 or the cDNA sequence thereof, which has pectinase activity;

(vi) a polypeptide derived from a mature polypeptide of SEQ ID NO: 59 by substitution, deletion or addition of one or several amino acids in the mature polypeptide of SEQ ID NO: 59, which has pectinase activity; and (vi) a fragment of the polypeptide of (i), (ii), (iii), (iv), (v) or (vi) that has pectinase activity;

(m)

(i) polypeptide having at least 98% identity, at least 98.5% identity, at least 99% identity, at least 99.5% identity, at least 99.6% identity, at least 99.7% identity, at least 99.8% identity, or at least 99.9% identity to SEQ ID NO: 62, which has pectinase activity;

(ii) a polypeptide having at least 98% identity, at least 98.5% identity, at least 99% identity, at least 99.5% identity, at least 99.6% identity, at least 99.7% identity, at least 99.8% identity, or at least 99.9% identity to SEQ ID NO: 63, which has pectinase activity;

(iii) a polypeptide having at least 98% identity, at least 98.5% identity, at least 99% identity, at least 99.5% identity, at least 99.6% identity, at least 99.7% identity, at least 99.8% identity, or at least 99.9% identity to a mature polypeptide of SEQ ID NO: 62, which has pectinase activity;

(iv) a polypeptide encoded by a polynucleotide that hybridizes under medium, medium-high, or high stringency conditions with the full-length complement of the mature polypeptide coding sequence of SEQ ID NO: 61 or the cDNA sequence thereof, which has pectinase activity;

(v) a polypeptide encoded by a polynucleotide having at least 98% identity, at least 98.5% identity, at least 99% identity, at least 99.5% identity, at least 99.6% identity, at least 99.7% identity, at least 99.8% identity, or at least 99.9% identity to the mature polypeptide coding sequence of SEQ ID NO: 61 or the cDNA sequence thereof, which has pectinase activity;

(vi) a polypeptide derived from a mature polypeptide of SEQ ID NO: 62 by substitution, deletion or addition of one or several amino acids in the mature polypeptide of SEQ ID NO: 62, which has pectinase activity; and (vi) a fragment of the polypeptide of (i), (ii), (iii), (iv), (v) or (vi) that has pectinase activity;

(n)

(i) polypeptide having at least 97% identity, at least 98% identity, or at least 99% identity to SEQ ID NO: 68, which has pectinase activity;

(ii) a polypeptide having at least 97% identity, at least 98% identity, or at least 99% identity to SEQ ID NO: 69, which has pectinase activity;

(iii) a polypeptide having at least 97% identity, at least 98% identity, or at least 99% identity to a mature polypeptide of SEQ ID NO: 68, which has pectinase activity;

(iv) a polypeptide encoded by a polynucleotide that hybridizes under medium, medium-high, or high stringency conditions with the full-length complement of the mature polypeptide coding sequence of SEQ ID NO: 67 or the cDNA sequence thereof, which has pectinase activity;

(v) a polypeptide encoded by a polynucleotide having at least 97% identity, at least 98% identity, or at least 99% identity to the mature polypeptide coding sequence of SEQ ID NO: 67 or the cDNA sequence thereof, which has pectinase activity;

(vi) a polypeptide derived from a mature polypeptide of SEQ ID NO: 68 by substitution, deletion or addition of one or several amino acids in the mature polypeptide of SEQ ID NO: 68, which has pectinase activity; and (vi) a fragment of the polypeptide of (i), (ii), (iii), (iv), (v) or (vi) that has having pectinase activity;

(o)

(i) polypeptide having at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 71, which has pectinase activity;

(ii) a polypeptide having at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 72, which has pectinase activity;

(iii) a polypeptide having at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to a mature polypeptide of SEQ ID NO: 71, which has pectinase activity;

(iv) a polypeptide encoded by a polynucleotide that hybridizes under medium, medium-high, or high stringency conditions with the full-length complement of the mature polypeptide coding sequence of SEQ ID NO: 70 or the cDNA sequence thereof, which has pectinase activity;

(v) a polypeptide encoded by a polynucleotide having at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 70 or the cDNA sequence thereof, which has pectinase activity;

(vi) a polypeptide derived from a mature polypeptide of SEQ ID NO: 71 by substitution, deletion or addition of one or several amino acids in the mature polypeptide of SEQ ID NO: 71, which has pectinase activity; and (vi) a fragment of the polypeptide of (i), (ii), (iii), (iv), (v) or (vi) that has pectinase activity;

(p)

(i) polypeptide having at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 74, which has pectinase activity;

(ii) at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 75, which has pectinase activity;

(iii) a polypeptide having at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to a mature polypeptide of SEQ ID NO: 74, which has pectinase activity;

(iv) a polypeptide encoded by a polynucleotide that hybridizes under medium, medium-high, or high stringency conditions with the full-length complement of the mature polypeptide coding sequence of SEQ ID NO: 73 or the cDNA sequence thereof, which has pectinase activity;

(v) a polypeptide encoded by a polynucleotide having at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 73 or the cDNA sequence thereof, which has pectinase activity;

(vi) a polypeptide derived from a mature polypeptide of SEQ ID NO: 74 by substitution, deletion or addition of one or several amino acids in the mature polypeptide of SEQ ID NO: 74, which has pectinase activity; and (vi) a fragment of the polypeptide of (i), (ii), (iii), (iv), (v) or (vi) that has pectinase activity;

(q)

(i) polypeptide having at least 60% identity, at least 65% identity, at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 83, which has pectinase activity;

(ii) a polypeptide having at least 60% identity, at least 65% identity, at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 84, which has pectinase activity;

(iii) a polypeptide having at least 60% identity, at least 65% identity, at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to a mature polypeptide of SEQ ID NO: 83, which has pectinase activity;

(iv) a polypeptide encoded by a polynucleotide that hybridizes under medium, medium-high, or high stringency conditions with the full-length complement of the mature polypeptide coding sequence of SEQ ID NO: 82 or the cDNA sequence thereof, which has pectinase activity;

(v) a polypeptide encoded by a polynucleotide having at least 60% identity, at least 65% identity, at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 82 or the cDNA sequence thereof, which has pectinase activity;

(vi) a polypeptide derived from a mature polypeptide of SEQ ID NO: 83 by substitution, deletion or addition of one or several amino acids in the mature polypeptide of SEQ ID NO: 83, which has pectinase activity; and (vi) a fragment of the polypeptide of (i), (ii), (iii), (iv), (v) or (vi) that has pectinase activity;

(r)

(i) polypeptide having at least 98.6% identity, at least 98.7% identity, at least 98.8% identity, at least 98.9% identity, at least 99% identity, at least 99.1% identity, at least 99.2% identity, at least 99.3% identity, at least 99.4% identity, at least 99.5% identity, at least 99.6% identity, at least 99.7% identity, at least 99.8% identity, or at least 99.9% identity to SEQ ID NO: 89, which has pectinase activity;

(ii) a polypeptide having at least 98.6% identity, at least 98.7% identity, at least 98.8% identity, at least 98.9% identity, at least 99% identity, at least 99.1% identity, at least 99.2% identity, at least 99.3% identity, at least 99.4% identity, at least 99.5% identity, at least 99.6% identity, at least 99.7% identity, at least 99.8% identity, or at least 99.9% identity to SEQ ID NO: 90, which has pectinase activity;

(iii) a polypeptide having at least 98.6% identity, at least 98.7% identity, at least 98.8% identity, at least 98.9% identity, at least 99% identity, at least 99.1% identity, at least 99.2% identity, at least 99.3% identity, at least 99.4% identity, at least 99.5% identity, at least 99.6% identity, at least 99.7% identity, at least 99.8% identity, or at least 99.9% identity to a mature polypeptide of SEQ ID NO: 89, which has pectinase activity;

(iv) a polypeptide encoded by a polynucleotide that hybridizes under medium, medium-high, or high stringency conditions with the full-length complement of the mature polypeptide coding sequence of SEQ ID NO: 88, which has pectinase activity;

(v) a polypeptide encoded by a polynucleotide having at least 98.6% identity, at least 98.7% identity, at least 98.8% identity, at least 98.9% identity, at least 99% identity, at least 99.1% identity, at least 99.2% identity, at least 99.3% identity, at least 99.4% identity, at least 99.5% identity, at least 99.6% identity, at least 99.7% identity, at least 99.8% identity, or at least 99.9% identity to the mature polypeptide coding sequence of SEQ ID NO: 88, which has pectinase activity;

(vi) a polypeptide derived from a mature polypeptide of SEQ ID NO: 89 by substitution, deletion or addition of one or several amino acids in the mature polypeptide of SEQ ID NO: 89, which has pectinase activity; and (vi) a fragment of the polypeptide of (i), (ii), (iii), (iv), (v) or (vi) that has pectinase activity;

(s)

(i) polypeptide having at least 60% identity, at least 65% identity, at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 92, which has pectinase activity;

(ii) a polypeptide having at least 60% identity, at least 65% identity, at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 93, which has pectinase activity;

(iii) a polypeptide having at least 60% identity, at least 65% identity, at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to a mature polypeptide of SEQ ID NO: 92, which has pectinase activity;

(iv) a polypeptide encoded by a polynucleotide that hybridizes under medium, medium-high, or high stringency conditions with the full-length complement of the mature polypeptide coding sequence of SEQ ID NO: 91 or the cDNA sequence thereof, which has pectinase activity;

(v) a polypeptide encoded by a polynucleotide having at least 60% identity, at least 65% identity, at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 91 or the cDNA sequence thereof, which has pectinase activity;

(vi) a polypeptide derived from a mature polypeptide of SEQ ID NO: 92 by substitution, deletion or addition of one or several amino acids in the mature polypeptide of SEQ ID NO: 92, which has pectinase activity; and (vi) a fragment of the polypeptide of (i), (ii), (iii), (iv), (v) or (vi) that has pectinase activity;

(t)

(i) polypeptide having at least 60% identity, at least 65% identity, at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 137, which has pectinase activity;

(ii) a polypeptide having at least 60% identity, at least 65% identity, at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 138, which has pectinase activity;

(iii) a polypeptide having at least 60% identity, at least 65% identity, at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to a mature polypeptide of SEQ ID NO: 137, which has pectinase activity;

(iv) a polypeptide encoded by a polynucleotide that hybridizes under medium, medium-high, or high stringency conditions with the full-length complement of the mature polypeptide coding sequence of SEQ ID NO: 136 or the cDNA sequence thereof, which has pectinase activity;

(v) a polypeptide encoded by a polynucleotide having at least 60% identity, at least 65% identity, at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 136 or the cDNA sequence thereof, which has pectinase activity;

(vi) a polypeptide derived from a mature polypeptide of SEQ ID NO: 137 by substitution, deletion or addition of one or several amino acids in the mature polypeptide of SEQ ID NO: 137, which has pectinase activity; and (vi) a fragment of the polypeptide of (i), (ii), (iii), (iv), (v) or (vi) that has pectinase activity;

(u)

(i) polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 140, which has pectinase activity;

(ii) a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 141, which has pectinase activity;

(iii) a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to a mature polypeptide of SEQ ID NO: 140, which has pectinase activity;

(iv) a polypeptide encoded by a polynucleotide that hybridizes under medium, medium-high, or high stringency conditions with the full-length complement of the mature polypeptide coding sequence of SEQ ID NO: 139 or the cDNA sequence thereof, which has pectinase activity;

(v) a polypeptide encoded by a polynucleotide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 139 or the cDNA sequence thereof, which has pectinase activity;

(vi) a polypeptide derived from a mature polypeptide of SEQ ID NO: 140 by substitution, deletion or addition of one or several amino acids in the mature polypeptide of SEQ ID NO: 140, which has pectinase activity; and (vi) a fragment of the polypeptide of (i), (ii), (iii), (iv), (v) or (vi) that has pectinase activity;

(v)

(i) polypeptide having at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 143, which has pectinase activity;

(ii) a polypeptide having at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 144, which has pectinase activity;

(iii) a polypeptide having at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to a mature polypeptide of SEQ ID NO: 143, which has pectinase activity;

(iv) a polypeptide encoded by a polynucleotide that hybridizes under medium, medium-high, or high stringency conditions with the full-length complement of the mature polypeptide coding sequence of SEQ ID NO: 142 or the cDNA sequence thereof, which has pectinase activity;

(v) a polypeptide encoded by a polynucleotide having at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 142 or the cDNA sequence thereof, which has pectinase activity;

(vi) a polypeptide derived from a mature polypeptide of SEQ ID NO: 143 by substitution, deletion or addition of one or several amino acids in the mature polypeptide of SEQ ID NO: 143, which has pectinase activity; and (vi) a fragment of the polypeptide of (i), (ii), (iii), (iv), (v) or (vi) that has pectinase activity; and (w)

(i) polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 146, which has pectinase activity;

(ii) a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 147, which has pectinase activity;

(iii) a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to a mature polypeptide of SEQ ID NO: 146, which has pectinase activity;

(iv) a polypeptide encoded by a polynucleotide that hybridizes under medium, medium-high, or high stringency conditions with the full-length complement of the mature polypeptide coding sequence of SEQ ID NO: 145 or the cDNA sequence thereof, which has pectinase activity;

(v) a polypeptide encoded by a polynucleotide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 145, which has pectinase activity;

(vi) a polypeptide derived from a mature polypeptide of SEQ ID NO: 146 by substitution, deletion or addition of one or several amino acids in the mature polypeptide of SEQ ID NO: 137, which has pectinase activity; and (vi) a fragment of the polypeptide of (i), (ii), (iii), (iv), (v) or (vi) that has pectinase activity.

2. The polypeptide of paragraph 1, having at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99% or 100% sequence identity to SEQ ID NO: 5, SEQ ID NO: 11, SEQ ID NO: 14, SEQ ID NO: 17, SEQ ID NO: 20, SEQ ID NO: 23, SEQ ID NO: 38, SEQ ID NO: 41, SEQ ID NO: 44, SEQ ID NO: 47, SEQ ID NO: 53, SEQ ID NO: 56, SEQ ID NO; 59, SEQ ID NO: 62, SEQ ID NO: 68, SEQ ID NO: 71, SEQ ID NO: 74, SEQ ID NO: 83, SEQ ID NO: 89, SEQ ID NO: 92, SEQ ID NO: 137, SEQ ID NO: 140, SEQ ID NO: 143, or SEQ ID NO: 146.

3. The polypeptide of paragraph 1 or 2, having at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99% or 100% sequence identity to the sequence of SEQ ID NO: 6, SEQ ID NO: 12, SEQ ID NO: 15, SEQ ID NO: 18, SEQ ID NO: 21, SEQ ID NO: 24, SEQ ID NO: 39, SEQ ID NO: 42, SEQ ID NO: 45, SEQ ID NO: 48, SEQ ID NO: 54, SEQ ID NO: 57, SEQ ID NO; 60, SEQ ID NO: 63, SEQ ID NO: 69, SEQ ID NO: 72, SEQ ID NO: 75, SEQ ID NO: 84, SEQ ID NO: 90, SEQ ID NO: 93, SEQ ID NO: 138, SEQ ID NO: 141, SEQ ID NO: 144, or SEQ ID NO: 147.

4. The polypeptide of any one of paragraphs 1-3, having at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99% or 100% sequence identity to a mature polypeptide of SEQ ID NO: 5, SEQ ID NO: 11, SEQ ID NO: 14, SEQ ID NO: 17, SEQ ID NO: 20, SEQ ID NO: 23, SEQ ID NO: 38, SEQ ID NO: 41, SEQ ID NO: 44, SEQ ID NO: 47, SEQ ID NO: 53, SEQ ID NO: 56, SEQ ID NO; 59, SEQ ID NO: 62, SEQ ID NO: 68, SEQ ID NO: 71, SEQ ID NO: 74, SEQ ID NO: 83, SEQ ID NO: 89, SEQ ID NO: 92, or SEQ ID NO: 137, SEQ ID NO: 140, SEQ ID NO: 143, or SEQ ID NO: 146.

5. The polypeptide of paragraph 1, comprising, consisting essentially of, or consisting of SEQ ID NO: 5, SEQ ID NO: 11, SEQ ID NO: 14, SEQ ID NO: 17, SEQ ID NO: 20, SEQ ID NO: 23, SEQ ID NO: 38, SEQ ID NO: 41, SEQ ID NO: 44, SEQ ID NO: 47, SEQ ID NO: 53, SEQ ID NO: 56, SEQ ID NO; 59, SEQ ID NO: 62, SEQ ID NO: 68, SEQ ID NO: 71, SEQ ID NO: 74, SEQ ID NO: 83, SEQ ID NO: 89, SEQ ID NO: 92, SEQ ID NO: 137, SEQ ID NO: 140, SEQ ID NO: 143, or SEQ ID NO: 146, or a mature polypeptide thereof; or SEQ ID NO: 6, SEQ ID NO: 12, SEQ ID NO: 15, SEQ ID NO: 18, SEQ ID NO: 21, SEQ ID NO: 24, SEQ ID NO: 39, SEQ ID NO: 42, SEQ ID NO: 45, SEQ ID NO: 48, SEQ ID NO: 54, SEQ ID NO: 57, SEQ ID NO; 60, SEQ ID NO: 63, SEQ ID NO: 69, SEQ ID NO: 72, SEQ ID NO: 75, SEQ ID NO: 84, SEQ ID NO: 90, SEQ ID NO: 93, SEQ ID NO: 138, SEQ ID NO: 141, SEQ ID NO: 144, or SEQ ID NO: 147.

8. A granule, which comprises:
(a) a core comprising the polypeptide of any one of paragraphs 1-7, and, optionally
(b) a coating consisting of one or more layer(s) surrounding the core.

9. A granule, which comprises:
(a) a core, and
(b) a coating consisting of one or more layer(s) surrounding the core, wherein the coating comprises the polypeptide of any one of paragraphs 1-7.

10. A composition comprising the polypeptide of any one of paragraphs 1-7 or the granule of paragraph 8 or 9.

11. A whole broth formulation or cell culture composition comprising the polypeptide of any one of paragraphs 1-7.

12. The composition of paragraph 10 or the whole broth formulation or cell culture composition of paragraph 11 further comprising an additional enzyme selected from the group consisting of alpha-amylase, beta-glucosidase, cellobiohydrolase, cellulase, endoglucanase, glucoamylase, protease, trehalase, and any combination thereof.

13. An isolated or purified polynucleotide encoding the polypeptide of any one of paragraphs 1-7.

14. A nucleic acid construct or expression vector comprising the polynucleotide of paragraph 13, wherein the polynucleotide is operably linked to one or more control sequences that direct the production of the polypeptide in an expression host.

15. A recombinant host cell comprising the polynucleotide of paragraph 14 operably linked to one or more control sequences that direct the production of the polypeptide.

16. A method of producing a polypeptide having pectinase activity, comprising cultivating the recombinant host cell of paragraph 14 under conditions conducive for production of the polypeptide, and optionally recovering the polypeptide.

17. Use of the polypeptide of any one of paragraphs 1-7, or the composition of paragraph 10, for hydrolyzing a fiber, preferably a fiber in cereal grains, such as corn, wheat, rice, oats, and barley, preferably wherein the fiber is degraded under acidic conditions having a pH less than or equal to 7.5.

18. Use of the polypeptide of any one of paragraph 1-7 or composition of any one of paragraph 10-12 for producing a fermentation product, preferably an alcohol, such as ethanol, preferably fuel ethanol.

19. A process for hydrolyzing a fiber, comprising contacting the fiber with an effective amount of polypeptide of any one of paragraphs 1-7 or composition of any one of paragraphs 10-12 under conditions suitable for hydrolyzing the fiber, preferably wherein the fiber is a cereal grain fiber, such as from corn, wheat, rice, oats, and barley, wherein the suitable conditions comprise acid conditions, for example a pH of less than or equal to 7.5.

20. A process for producing a fermentation product from a starch-containing or cellulosic-containing material containing fiber, wherein a partially degraded starch-containing or cellulosic-containing material containing fiber is contacted with an effective amount of a polypeptide of any one of paragraphs 1-7 or composition of any one of paragraphs 10-12 during saccharification, fermentation, or simultaneous saccharification and fermentation using a fermenting organism to produce the fermentation product, wherein the fermentation product is preferably an alcohol, such as ethanol, preferably fuel ethanol, preferably wherein the fiber is cereal grain fiber, such as from corn, wheat, rice, oats, and barley.

21. A process for producing fermentation products from starch-containing material comprising:

i) saccharifying the starch-containing material using a carbohydrate-source generating enzyme at a temperature below the initial gelatinization temperature;

ii) fermenting using a fermenting organism;

wherein at least one polypeptide having pectinase activity is present or added during saccharifying step i) or fermenting step ii), and wherein the at least one polypeptide having pectinase activity is selected from the group consisting of a polygalacturonase from the GH28 family, a rhamnogalacturonase, from the GH28 family, a pectin methyl esterase from the CE8 family, a pectin lyase from the PL1 family, a pectin acetyl esterase from the CE12 family or CE16 family, a rhamnogalacturonan lyase from the PL4 family, a beta-galactanase from the GH53 family, and combinations thereof.

22. A process for producing fermentation products from cellulosic-containing material comprising:

i) optionally pretreating a cellulosic-containing material;

ii) saccharifying a cellulosic-containing material and/or pretreated cellulosic-containing material using a carbohydrate-source generating enzyme; and iii) fermenting using a fermenting organism;

wherein at least one polypeptide having pectinase activity is present or added during saccharifying step i) or fermenting step ii), and wherein the at least one polypeptide having pectinase activity is selected from the group consisting of a polygalacturonase from the GH28 family, a rhamnogalacturonase, from the GH28 family, a pectin methyl esterase from the CE8 family, a pectin lyase from the PL1 family, a pectin acetyl esterase from the CE12 family or CE16 family, a rhamnogalacturonan lyase from the PL4 family, a beta-galactanase from the GH53 family, and combinations thereof.

23. A process for producing fermentation products from starch-containing material comprising the steps of:

i) liquefying the starch-containing material at a temperature above the initial gelatinization temperature using an alpha-amylase;

ii) saccharifying using a carbohydrate-source generating enzyme;

iii) fermenting using a fermenting organism;

wherein at least one polypeptide having pectinase activity is present or added during saccharifying step i) or fermenting step ii), and wherein the at least one polypeptide having pectinase activity is selected from the group consisting of a polygalacturonase from the GH28 family, a rhamnogalacturonase, from the GH28 family, a pectin methyl esterase from the CE8 family, a pectin lyase from the PL1 family, a pectin acetyl esterase from the CE12 family or CE16 family, a rhamnogalacturonan lyase from the PL4 family, a beta-galactanase from the GH53 family, and combinations thereof.

24. The process of any one of paragraphs 21-23, wherein the at least one polypeptide having pectinase activity is a polygalacturonase from the GH28 family.

25. The process of any one of paragraphs 21-24, wherein the polygalacturonase from the GH28 family is a polygalacturonase I, a polygalacturonase II, or a polygalacturonase III.

26. The process of any one of paragraphs 21-25, wherein the polygalacturonase from the GH28 family is from a strain of *Aspergillus* or is a non-naturally occurring variant of an *Aspergillus* polygalacturonase, preferably *Aspergillus aculeatus, Aspergillus luchuensis, Aspergillus niger*, or a strain of *Thermoascus* or is a non-naturally occurring variant of a *Thermoascus* polygalacturonase, preferably *Thermoascus crustaceus*.

27. The process of any one of paragraphs 21-26, wherein the polygalacturonase from the GH28 family is selected from the group consisting of:

(i) the mature polypeptide of SEQ ID NO: 2, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to SEQ ID NO: 2 or SEQ ID NO: 3;

(ii) the mature polypeptide of SEQ ID NO: 5, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity or at least 99% identity to SEQ ID NO: 5 or SEQ ID NO: 6;

(iii) the mature polypeptide of SEQ ID NO: 8, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity or at least 99% identity to SEQ ID NO: 8 or SEQ ID NO: 9;

(iv) the mature polypeptide of SEQ ID NO: 11, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity or at least 99% identity to SEQ ID NO: 11 or SEQ ID NO: 12;

(v) the mature polypeptide of SEQ ID NO: 14, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 14 or SEQ ID NO: 15;

(vi) the mature polypeptide of SEQ ID NO: 17, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 17 or SEQ ID NO: 18;

(vii) the mature polypeptide of SEQ ID NO: 20, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 20 or SEQ ID NO: 21;

(viii) the mature polypeptide of SEQ ID NO: 23, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 23 or SEQ ID NO: 24;

(ix) the mature polypeptide of SEQ ID NO: 26, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 26 or SEQ ID NO: 27;

(x) the mature polypeptide of SEQ ID NO: 29, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 29 or SEQ ID NO: 30;

(xi) the mature polypeptide of SEQ ID NO: 32, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 32 or SEQ ID NO: 33;

(xii) the mature polypeptide of SEQ ID NO: 35, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 35 or SEQ ID NO: 36;

(xiii) the mature polypeptide of SEQ ID NO: 38, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 38 or SEQ ID NO: 39;

(xiv) the mature polypeptide of SEQ ID NO: 41, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 41 or SEQ ID NO: 42;

(xv) the mature polypeptide of SEQ ID NO: 44, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 44 or SEQ ID NO: 45; and (xvi) the mature polypeptide of SEQ ID NO: 143, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 143 or SEQ ID NO: 144.

28. The process of any one of paragraphs 21-27, wherein the at least one polypeptide having pectinase activity is a rhamnogalacturonase from the GH28 family.

29. The process of any one of paragraphs 21-28, wherein the rhamnogalacturonase from the GH28 family is a rhamnogalacturonase I, or a rhamnogalacturonase II.

30. The process of any one of paragraphs 21-29, wherein the rhamnogalacturonase from the GH28 family is from a strain of *Aspergillus* or is a non-naturally occurring variant of an *Aspergillus* rhamnogalacturonase, preferably *Aspergillus aculeatus, Aspergillus luchuensis, Aspergillus niger*, or *Aspergillus oryzae*, from a strain of *Penicillium* or is a non-naturally occurring variant of a *Penicillium* rhamnogalacturonase, preferably *Penicillium* sp. XZ2495 or *Penicillium* sp. 54788, or is from a strain of *Talaromyces* or is a non-naturally occurring variant of a *Talaromyces* rhamnogalacturonase, preferably *Talaromyces leycettanus* or *Talaromyces calidicanius*.

31. The process of any one of paragraphs 21-30, wherein the rhamnogalacturonase from the GH28 family selected from the group consisting of:

(i) the mature polypeptide of SEQ ID NO: 47, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to SEQ ID NO: 47 or SEQ ID NO: 48;

(ii) the mature polypeptide of SEQ ID NO: 50, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity or at least 99% identity to SEQ ID NO: 50 or SEQ ID NO: 51;

(iii) the mature polypeptide of SEQ ID NO: 53, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity or at least 99% identity to SEQ ID NO: 53 or SEQ ID NO: 54;

(iv) the mature polypeptide of SEQ ID NO: 56, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity or at least 99% identity to SEQ ID NO: 56 or SEQ ID NO: 57;

(v) the mature polypeptide of SEQ ID NO: 59, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 59 or SEQ ID NO: 60;

(vi) the mature polypeptide of SEQ ID NO: 62, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 62 or SEQ ID NO: 63;

(vii) the mature polypeptide of SEQ ID NO: 134, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 134 or SEQ ID NO: 135; and (viii) the mature polypeptide of SEQ ID NO: 146, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 146 or SEQ ID NO: 147.

32. The process of any one of paragraphs 21-31, wherein the polypeptide having pectinase activity is a pectin methyl esterase from the CE8 family.

33. The process of any one of paragraphs 21-32, wherein the pectin methyl esterase from the CE8 family is from a strain of *Aspergillus* or is a non-naturally occurring variant of an *Aspergillus* pectin methyl esterase.

34. The process of any one of paragraphs 21-33, wherein the pectin methyl esterase from the CE8 family is from a strain of *Aspergillus* selected from the group consisting of *Aspergillus aculeatus, Aspergillus luchuensis*, and *Aspergillus niger*.

35. The process of any one of paragraphs 21-34, wherein the pectin methyl esterase from the CE8 family is selected from the group consisting of:

(i) the mature polypeptide of SEQ ID NO: 65, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to SEQ ID NO: 65 or SEQ ID NO: 66;

(ii) the mature polypeptide of SEQ ID NO: 68, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity or at least 99% identity to SEQ ID NO: 68 or SEQ ID NO: 69;

(iii) the mature polypeptide of SEQ ID NO: 71, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity or at least 99% identity to SEQ ID NO: 71 or SEQ ID NO: 72; and (iv) the mature polypeptide of SEQ ID NO: 74, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity or at least 99% identity to SEQ ID NO: 74 or SEQ ID NO: 75.

36. The process of any one of paragraphs 21-35, wherein the polypeptide having pectinase activity is a pectin lyase from the PL1 family, preferably PL1 subfamily 4.

37. The process of any one of paragraphs 21-36, wherein the pectin lyase from the PL1 family, preferably PL1 subfamily 4, is from a strain of *Aspergillus* or is a non-naturally occurring variant of an *Aspergillus* pectin lyase, preferably *Aspergillus luchuensis* or *Aspergillus niger*, or from a strain of *Thielavia* or a non-naturally occurring variant of a *Thielavia* pectin lyase, preferably *Thielavia hyrcaniae.*

38. The process of any one of paragraphs 21-37, wherein the pectin lyase from the PL1 family, preferably PL1 subfamily 4, is selected from the group consisting of:

(i) the mature polypeptide of SEQ ID NO: 77, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to SEQ ID NO: 77 or SEQ ID NO: 78; and (ii) the mature polypeptide of SEQ ID NO: 80, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity or at least 99% identity to SEQ ID NO: 80 or SEQ ID NO: 81;

(iii) the mature polypeptide of SEQ ID NO: 107, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity or at least 99% identity to SEQ ID NO: 107 or SEQ ID NO: 108.

39. The process of any one of paragraphs 21-38, wherein the polypeptide having pectinase activity is a pectin acetyl esterase from the CE12 family or CE16 family.

40. The process of any one of paragraphs 21-39, wherein the pectin acetyl esterase from the CE12 family or the CE16 family is from a strain of *Aspergillus* or is a non-naturally occurring variant of an *Aspergillus* pectin acetyl esterase, preferably *Aspergillus aculeatus* or *Aspergillus oryzae*, or is from a strain of *Colletotrichum* or is a non-naturally occurring variant of a *Colletotrichum* pectin acetyl esterase, preferably *Colletotrichum gloeosporioides.*

41. The process of any one of paragraphs 21-40, wherein the pectin acetyl esterase from the CE12 family or the CE16 family is selected from the group consisting of:

(i) the mature polypeptide of SEQ ID NO: 83, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to SEQ ID NO: 83 or SEQ ID NO: 84;

(ii) the mature polypeptide of SEQ ID NO: 86, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity or at least 99% identity to SEQ ID NO: 86 or SEQ ID NO: 87;

(iii) the mature polypeptide of SEQ ID NO: 89, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity or at least 99% identity to SEQ ID NO: 89 or SEQ ID NO: 90; and (iv) the mature polypeptide of SEQ ID NO: 92, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity or at least 99% identity to SEQ ID NO: 92 or SEQ ID NO: 93.

42. The process of any one of paragraphs 21-41, wherein the at least one polypeptide having pectinase activity is a rhamnogalacturonan lyase from the PL4 family, preferably PL4 subfamily 1, PL4 subfamily 3, or PL4 subfamily 5.

43. The process of any one of paragraphs 21-42, wherein the rhamnogalacturonan lyase from the PL4 family, preferably PL4 subfamily 1, PL4 subfamily 3, or PL4 subfamily 5, is from a strain of *Aspergillus* or is a non-naturally occurring variant of an *Aspergillus* rhamnogalacturonan lyase, preferably *Aspergillus aculeatus* or *Aspergillus oryzae.*

44. The process of any one of paragraphs 21-43, wherein the rhamnogalacturonan lyase from the PL4 family, preferably PL4 subfamily 1, PL4 subfamily 3, or PL4 subfamily 5, is selected from the group consisting of:

(i) the mature polypeptide of SEQ ID NO: 95, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to SEQ ID NO: 95 or SEQ ID NO: 96;

(ii) the mature polypeptide of SEQ ID NO: 98, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity or at least 99% identity to SEQ ID NO: 98 or SEQ ID NO: 99;

(iii) the mature polypeptide of SEQ ID NO: 101, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity or at least 99% identity to SEQ ID NO: 101 or SEQ ID NO: 102;

(iv) the mature polypeptide of SEQ ID NO: 137, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity or at least 99% identity to SEQ ID NO: 137 or SEQ ID NO: 138; and (v) the mature polypeptide of SEQ ID NO: 140, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 140 or SEQ ID NO: 141.

45. The process of any one of paragraphs 21-44, wherein the at least one polypeptide having pectinase activity is a beta-galactanase from the GH53 family.

46. The process of any one of paragraphs 21-45, wherein the beta-galactanase from the GH53 family is from a strain of *Aspergillus* or is a non-naturally occurring variant of an *Aspergillus* beta-galactanase, preferably *Aspergillus aculeatus.*

47. The process of any one of paragraphs 21-46, wherein the beta-galactanase from the GH53 family comprises, consists of, or consists essentially of the mature polypeptide of SEQ ID NO: 104, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to SEQ ID NO: 104 or SEQ ID NO: 105.

48. The process of any one of paragraphs 21-47, wherein the at least one polypeptide having pectinase activity comprises at least two polypeptides having a different type of pectinase activity selected from the group consisting of a polygalacturonase from the GH28 family, a rhamnogalacturonase, from the GH28 family, a pectin methyl esterase from the CE8 family, a pectin lyase from the PL1 family, a pectin acetyl esterase from the CE12 family or CE16 family, a rhamnogalacturonan lyase from the PL4 family, and a beta-galactanase from the GH53 family.

49. The process of paragraph 48, wherein the at least two polypeptides having a different type of pectinase activity comprise:

(i) a polygalacturonase from the GH28 family; and (ii) a polypeptide having pectinase activity selected from the group consisting of a rhamnogalacturonase from the GH28 family, a pectin methyl esterase from the CE8 family, a pectin lyase from the PL1 family, a pectin acetyl esterase from the CE12 family or CE16 family, a rhamnogalacturonan lyase from the PL4 family, and a beta-galactanase from the GH53 family.

50. The process of paragraphs 48 or 49, wherein the at least two polypeptides having a different type of pectinase activity comprise a polygalacturonase from the GH28 family and a pectin methyl esterase from the CE8 family.

51. The process of any one of paragraphs 48-50, wherein the at least two polypeptides having a different type of pectinase activity comprise a polygalacturonase from the GH28 family and a pectin acetyl esterase from the CE12 family or CE16 family.

52. The process of any one of paragraphs 48-51, wherein the at least two polypeptides having a different type of pectinase activity comprise a polygalacturonase from the GH28 family and a rhamnogalacturonase from the GH28 family.

53. The process of any one of paragraphs 48-52, wherein the polygalacturonase from the GH28 family is selected from the group of an endo-polygalacturonase I, an exo-polygalacturonase I, an endo-polygalacturonase II, an exo-polygalacturonase II, an endo-polygalacturonase III, and an exo-polygalacturonase III.

54. The process of any one of paragraphs 48-53, wherein the at least two polypeptides having a different type of pectinase activity comprise an exo-polygalacturonase II from the GH28 family and a pectin methyl esterase from the CE8 family.

55. The process of paragraph 54, wherein the at least two polypeptides comprise:

(i) an *Aspergillus* endo-polygalacturonase from the GH28 family, for example, *Aspergillus tubingensis* and an *Aspergillus* pectin methyl esterase, for example, an *Aspergillus niger* pectin methyl esterase from the CE8 family; or (ii) a polypeptide having polygalacturonase activity comprising, consisting of, or consisting essentially of the mature polypeptide of SEQ ID NO: 2 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 2 or SEQ ID NO: 3, and a polypeptide having pectin methyl esterase activity comprising, consisting of, or consisting essentially of the mature polypeptide of SEQ ID NO: 65 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 65 or SEQ ID NO: 66.

56. The process of any one of paragraphs 49-55, wherein the at least two polypeptides comprise at least three polypeptides having pectinase activity, wherein the at least three polypeptides comprise:

(i) an *Aspergillus* pectin methyl esterase from the CE8 family, for example, from *Aspergillus luchuensis*, an *Aspergillus* endo-polygalaacturonase II (PGII) from the GH28 family, for example, from *Aspergillus aculeatus* and an *Aspergillus* pectin lyase A, for example, from *Aspergillus niger;*

(ii) a *Sporormia* rhamnogalacturon lyase from the PL4_1 family, for example, from *Sporormia fimetaria*, a *Thielavia* pectin lyase from the PL1_4 family, for example, *Thielavia hyrcaniae*, a *Penicillium* polygalacturonase from the GH28 family, for example *Penicillium oxalicum;*

(iii) a polypeptide having polygalacturonase activity comprising, consisting of, or consisting essentially of the mature polypeptide of SEQ ID NO: 2 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 2 or SEQ ID NO: 3, a polypeptide having pectin methyl esterase activity comprising, consisting of, or consisting essentially of the mature polypeptide of SEQ ID NO: 65 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 65 or SEQ ID NO: 66, and a polypeptide having pectin lyase activity comprising, consisting of, or consisting essentially of the mature polypeptide of SEQ ID NO: 107 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 107 or SEQ ID NO: 108; and (iv) a polypeptide having polygalacturonase activity comprising, consisting of, or consisting essentially of the mature polypeptide of SEQ ID NO: 143 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 143 or SEQ ID NO: 144, a polypeptide having rhamnogalacturonan lyase activity comprising, consisting of, or consisting essentially of the mature polypeptide of SEQ ID NO: 140 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 65 or SEQ ID NO: 140 or SEQ ID NO: 141, and a polypeptide having pectin lyase activity comprising, consisting of, or consisting essentially of the mature polypeptide of SEQ ID NO: 107 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 107 or SEQ ID NO: 108.

57. The process of any one of paragraphs 1-56, wherein the at least one or at least two polypeptides having pectinase activity are dosed in the range 0.1-1000 micro gram EP/g DS; 0.5-500 micro gram EP/g DS; 1-100 micro gram EP/g DS; such as 5-50 micro gram EP/g DS.

58. The process of any one of paragraphs 1-57, wherein saccharification is performed in the presence of at least one cellulase/cellulolytic composition.

59. The process of paragraph 58, wherein the cellulases/cellulolytic composition are derived from a strain of *Trichoderma*, in particular *Trichoderma reesei*, or a strain of *Humicola*, in particular *Humicola insolens*, or a strain of *Chrysosporium*, in particular *Chrysosporium lucknowense.*

60. The process of any one of paragraphs 58-59, wherein the cellulases/cellulolytic composition comprises a beta-glucosidase, a cellobiohydrolase and an endoglucanase.

61. The process of any one of paragraphs 58-60, wherein the cellulases/cellulolytic composition comprises one or more polypeptides selected from the group consisting of:

beta-glucosidase;

cellobiohydrolase I; and endoglucanase I, or a mixture of two or three thereof.

62. The process of any one of paragraphs 58-61, wherein the cellulases/cellulolytic composition comprises one or more of the following components:

(i) an *Aspergillus fumigatus* beta-glucosidase or a variant thereof;

(ii) an *Aspergillus fumigatus* cellobiohydrolase I; and (iii) a *Trichoderma reesei* endoglucanase I.

63. The process of any one of paragraphs 58-62, wherein the cellulases/cellulolytic composition is a *Trichoderma reesei* cellulolytic composition further comprising:

(i) an *Aspergillus fumigatus* beta-glucosidase disclosed in SEQ ID NO: 110 or a variant thereof with the following substitutions: F100D, S283G, N456E, F512Y having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 110; (ii) a cellobiohydrolase I (CBH I), such as one derived from a strain of the genus *Aspergillus*, such as a strain of *Aspergillus fumigatus*, such as the CBHI disclosed as SEQ ID NO: 111, or a CBHI having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 111; and (iii) an endoglucanase I (EGI), such as one derived from a strain of the genus *Trichoderma*, such as a strain of *Trichoderma reesei*, such as the EGI disclosed as SEQ ID NO: 113, or an EGI having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 113.

64. The process of any one of paragraphs 58-63, wherein the cellulases/cellulolytic composition comprises one or more polypeptides selected from the group consisting of:

GH61 polypeptide having cellulolytic enhancing activity;
beta-glucosidase;
Cellobiohydrolase I;
Cellobiohydrolase II;
or a mixture of two, three, or four thereof.

65. The process of any one of paragraphs 58-64, wherein the cellulases/cellulolytic composition comprises one or more of the following components:

(i) an *Aspergillus fumigatus* cellobiohydrolase I;
(ii) an *Aspergillus fumigatus* cellobiohydrolase II;
(iii) an *Aspergillus fumigatus* beta-glucosidase or variant thereof; and
(iv) a *Penicillium* sp. GH61 polypeptide having cellulolytic enhancing activity; or homologs thereof.

66. The process of any one of paragraphs 58-65, wherein the cellulases/cellulolytic composition is a *Trichoderma reesei* cellulolytic enzyme composition further comprising *Penicillium emersonii* GH61A polypeptide having cellulolytic enhancing activity disclosed in SEQ ID NO: 109, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 109 and an *Aspergillus fumigatus* beta-glucosidase disclosed in SEQ ID NO: 110 or a variant thereof with the following substitutions: F100D, S283G, N456E, F512Y having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 110.

67. The process of any one of paragraphs 58-66, wherein the cellulolytic composition comprises a cellobiohydrolase I (CBH I), such as one derived from a strain of the genus *Aspergillus*, such as a strain of *Aspergillus fumigatus*, such as the CBHI disclosed as SEQ ID NO: 111, or CBH I having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 111.

68. The process of any one of paragraphs 58-67, wherein the cellulolytic composition comprises a cellobiohydrolase II (CBH II), such as one derived from a strain of the genus *Aspergillus*, such as a strain of *Aspergillus fumigatus*; such as the CBH II disclosed as SEQ ID NO: 112, or a CBH II having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 112.

69. The process of any one of paragraphs 21-68, wherein a trehalase is present and/or added during saccharification and/or fermentation.

70. The process of paragraph 69, wherein the trehalase present and/or added during saccharification and/or fermentation is a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 129 and having trehalase activity.

71. The process of paragraph 69, wherein the trehalase present and/or added during saccharification and/or fermentation is a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 130 and having trehalase activity.

72. The process of any one of paragraphs 21-71, wherein the carbohydrate-source generating enzyme(s) is at least a glucoamylase and optionally in combination with a fungal acid alpha-amylase.

73. The process of any one of paragraphs 21-72, wherein the carbohydrate-source generating enzyme(s) comprise a glucoamylase and a fungal acid alpha-amylase.

74. The process of any one of paragraphs 21-73, wherein the glucoamylase is present and/or added during saccharification and/or fermentation.

75. The process of paragraphs 74, wherein the glucoamylase present and/or added during saccharification and/or fermentation is of fungal origin, preferably from a stain of *Aspergillus*, preferably *A. niger, A. awamori*, or *A. oryzae*; or a strain of *Trichoderma*, preferably *T. reesei*; or a strain of *Talaromyces*, preferably *Talaromyces emersonii*, or a strain of *Trametes*, preferably *Trametes cingulata*, or a strain of *Pycnoporus*, or a strain of *Gloeophyllum*, such as a strain of *Gloeophyllum sepiarium* or *Gloeophyllum trabeum* or a strain of the *Nigrofomes*.

76. The process of paragraphs 74-75, wherein the glucoamylase present and/or added during saccharification and/or fermentation is a blend comprising *Talaromyces emersonii* glucoamylase of SEQ ID NO: 124, or glucoamylase having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 124, a *Trametes cingulata* glucoamylase of SEQ ID NO: 123, or glucoamylase having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 123, and a *Rhizomucor pusillus* alpha-amylase with an *Aspergillus niger* glucoamylase linker and starch-binding domain (SBD), of SEQ ID NO: 128, and comprising the following substitutions: G128D+D143N, and having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 128.

77. The process of any one of paragraphs 74-76, wherein the glucoamylase present and/or added during saccharification and/or fermentation is a blend comprising *Gloeophyllum sepiarium* glucoamylase shown as SEQ ID NO: 126, or a glucoamylase having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 126, and an alpha-amylase from *Rhizomucor pusillus* with an *Aspergillus niger* glucoamylase linker and starch-binding domain (SBD), disclosed SEQ ID NO: 128 with the following substitutions: G128D+D143N, and having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 40.

78. The process of any one of paragraph 23-77, wherein liquefaction is performed in the presence of an additional enzyme selected from the group consisting of a thermostable endoglucanase, a thermostable glucoamylase, a thermostable phytase, a thermostable protease, a thermostable xylanase, and any combination thereof.

79. The process of any one of paragraphs 23-78, wherein liquefaction is performed in the presence of a thermostable protease.

80. The process of any one of paragraphs 23-79, wherein the protease has a thermostability value of more than 20% determined as Relative Activity at 80° C./70° C.

81. The process of any one of paragraphs 23-80, wherein liquefaction is performed in the presence of a thermostable glucoamylase.

82. The process of any one of paragraphs 23-80, wherein liquefaction is performed in the presence of a thermostable alpha-amylase.

83. The process of any one of paragraphs 23-80, wherein the alpha-amylase is a bacterial or fungal alpha-amylase.

84. The process of any one of paragraphs 23-83, wherein the alpha-amylase is from the genus *Bacillus*, such as a strain of *Bacillus stearothermophilus*, in particular a variant of a *Bacillus stearothermophilus* alpha-amylase, such as the one shown in SEQ ID NO: 114, or alpha-amylase having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 30.

85. The process of paragraph 84, wherein the *Bacillus stearothermophilus* alpha-amylase comprises a deletion of two amino acids in the region corresponding to positions 179-182 using SEQ ID NO: 114 for numbering.

86. The process of paragraph 85, wherein the deletion is selected from the group consisting of 179*+180*, 179*+181*, 179*+182*, 180*+181*, 180*+182*, and 181*+182*, particularly I181*+G182*.

87. The process of any one of paragraphs 84-86, wherein the alpha-amylase comprises a substitution N193F using SEQ ID NO: 114 for numbering.

88. The process of any one of paragraphs 84-86 wherein the *Bacillus stearothermophilus* alpha-amylase has a substitution in position S242, preferably S242Q substitution using SEQ ID NO: 114 for numbering.

89. The process of any one of paragraphs 84-88, wherein the *Bacillus stearothermophilus* alpha-amylase has a substitution in position E188, preferably E188P substitution using SEQ ID NO: 114 for numbering.

90. The process of any one of paragraphs 23-89, wherein the alpha-amylase has a T½ (min) at pH 4.5, 85° C., 0.12 mM $CaCl_2$) of at least 10, such as at least 15, such as at least 20, such as at least 25, such as at least 30, such as at least 40, such as at least 50, such as at least 60, such as between 10-70, such as between 15-70, such as between 20-70, such as between 25-70, such as between 30-70, such as between 40-70, such as between 50-70, such as between 60-70.

91. The process of any one of paragraphs 23-90, wherein the alpha-amylase is selected from the following group of *Bacillus stearothermophilus* alpha-amylase variants (using SEQ ID NO: 114 for numbering):

I181*+G182*+N193F+E129V+K177L+R179E;

I181*+G182*+N193F+V59A+Q89R+E129V+K177L+R179E+H208Y+K220P+N224L+Q254S

I181*+G182*+N193F+V59A+Q89R+E129V+K177L+R179E+Q254S+M284V;

I181*+G182*+N193F+V59A+E129V+K177L+R179E+Q254S+M284V;

I181*+G182*+N193F+E129V+K177L+R179E+K220P+N224L+S242Q+Q254S;

I181*+G182*+V59A+E129V+K177L+R179E+Q254S+M284V+V212T+Y268G+N293Y+T297N;

I181*+G182*+V59A+E129V+K177L+R179E+Q254S+M284V+V212T+Y268G+N293Y+T297N+S173N+E188P+H208Y+S242Y+K279I;

I181*+G182*+V59A+E129V+K177L+R179S+Q254S+M284V+V212T+Y268G+N293Y+T297N+A184Q+E188P+T191N

I181*+G182*+V59A+E129V+K177L+R179S+Q254S+M284V+V212T+Y268G+N293Y+T297N+A184Q+E188P+T191N+S242Y+K279I;

I181*+G182*+V59A+E129V+K177L+R179E+Q254S+M284V+V212T+Y268G+N293Y+T297N+E188P+K279W;

I181*+G182*+V59A+E129V+K177L+R179E+Q254S+M284V+V212T+Y268G+N293Y+T297N+W115D+D117Q+T133P;

and wherein the variant has at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 114.

92. The process of any one of paragraphs 23-91, wherein a protease with a thermostability value of more than 25% determined as Relative Activity at 80° C./70° C. is present in liquefaction step i).

93. The process of any one of paragraphs 23-92, wherein the protease has a thermostability of more than 30%, more than 40%, more than 50%, more than 60%, more than 70%, more than 80%, more than 90%, more than 100%, such as more than 105%, such as more than 110%, such as more than 115%, such as more than 120% determined as Relative Activity at 80° C./70° C.

94. The process of any one of paragraphs 23-93, wherein the protease has a thermostability of between 20% and 50%, such as between 20% and 40%, such as 20% and 30% determined as Relative Activity at 80° C./70° C.

95. The process of any one of paragraphs 23-94, wherein the protease has a thermostability between 50% and 115%, such as between 50% and 70%, such as between 50% and 60%, such as between 100% and 120%, such as between 105% and 115% determined as Relative Activity at 80° C./70° C.

96. The process of any one of paragraphs 23-95, wherein the protease has a thermostability of more than 10%, such as more than 12%, more than 14%, more than 16%, more than 18%, more than 20%, more than 30%, more than 40%, more that 50%, more than 60%, more than 70%, more than 80%, more than 90%, more than 100%, more than 110% determined as Relative Activity at 85° C./70° C.

97. The process of any one of paragraphs 23-97, wherein the protease has thermostability of between 10% and 50%, such as between 10% and 30%, such as between 10% and 25% determined as Relative Activity at 85° C./70° C.

98. The process of any one of paragraphs 23-97, wherein the protease has a thermostability above 60%, such as above 90%, such as above 100%, such as above 110% at 85° C. as determined using the Zein-BCA assay.

99. The process of any one of paragraphs 23-98, wherein the protease has a thermostability between 60-120, such as between 70-120%, such as between 80-120%, such as between 90-120%, such as between 100-120%, such as 110-120% at 85° C. as determined using the Zein-BCA assay.

100. The process of any one of paragraphs 23-99, wherein the protease is of fungal or bacterial origin.

101. The process of any one of paragraphs 23-100, wherein the protease is a metallo protease or a serine protease.

102. The process of paragraph 101, wherein the protease is a variant of the metallo protease derived from a strain of the genus *Thermoascus*, preferably a strain of *Thermoascus aurantiacus*, especially *Thermoascus aurantiacus* CGMCC No. 0670.

103. The process of paragraph 102, wherein the protease is a variant of the metallo protease disclosed as SEQ ID NO: 115 with the following mutations:

D79L+S87P+A112P+D142L;

D79L+S87P+D142L; or

A27K+D79L+Y82F+S87G+D104P+A112P+A126V+D142L; and wherein the protease has at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 115.

104. The process of paragraph 102, wherein the protease is a serine protease, particularly an S8 serine protease derived from a strain of *Pyrococcus*, preferably a strain of *Pyrococcus furiosus*, or derived from a strain of *Thermococcus*, preferably *Thermococcus thioreducens* or *Thermococcus* nautili, or derived from a strain of *Palaeococcus*, preferably *Palaeococcus ferrophilus*

105. The process of paragraph 102, wherein the protease is derived from a strain of *Pyrococcus*, preferably a strain of *Pyrococcus furiosus.*

106. The process of any of paragraph 105, wherein the protease is the one shown in SEQ ID NO: 116, or a protease having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 116.

107. The process of any one of paragraph 23 to 106, wherein the protease is derived from a strain of *Thermobifida*, preferably a strain of *Thermobifida cellulosytica.*

108. The process of paragraph 107, wherein the protease is the one shown in SEQ ID NO: 118, or a protease having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 118.

109. The process of any one of paragraphs 21-108, wherein saccharification and fermentation are carried out simultaneously.

110. The process of any one of paragraphs 21-109, wherein saccharification and fermentation are carried out sequentially.

111. The process of any one of paragraphs 21-110, wherein fermentation or simultaneous saccharification and fermentation (SSF) are carried out at a temperature from 25° C. to 40° C., such as from 28° C. to 35° C., such as from 30° C. to 34° C., preferably around about 32° C.

112. The process of any one of paragraphs 21-111, wherein the fermentation product is an alcohol, preferably ethanol, especially fuel ethanol, potable ethanol and/or industrial ethanol.

113. The process of any one of paragraphs 21-112, wherein the fermentation product is recovered after fermentation, such as by distillation.

114. The process of any one of paragraphs 21-113, wherein the starch-containing starting material is whole grains.

115. The process of any one of paragraphs 21-114, wherein the starch-containing material is derived from corn, wheat, barley, rye, milo, sago, cassava, manioc, tapioca, sorghum, rice or potatoes.

116. The process of any one of paragraphs 21-115, wherein the organism applied in fermentation is a yeast, particularly a *Saccharomyces* spp., more particular *Saccharomyces cerevisiae.*

117. An enzyme blend or enzyme composition comprising a polypeptide having pectinase any one of paragraphs 1-56.

118. The blend or composition of paragraph 117, further comprising a carbohydrate-source generating enzyme, particularly a glucoamylase.

119. The blend or composition of paragraphs 117-118, further comprising a cellulase/cellulolytic composition comprising a beta-glucosidase, a cellobiohydrolase and an endoglucanase.

120. The blend or composition of paragraph 119, wherein the cellulases/cellulolytic composition comprises one or more polypeptides selected from the group consisting of:

GH61 polypeptide having cellulolytic enhancing activity, beta-glucosidase;

Cellobiohydrolase I;

Cellobiohydrolase II;

or a mixture of two, three, or four thereof.

121. The blend or composition of paragraphs 119-120, wherein the cellulases/cellulolytic composition comprises one or more of the following components:

(i) an *Aspergillus fumigatus* cellobiohydrolase I;

(ii) an *Aspergillus fumigatus* cellobiohydrolase II;

(iii) an *Aspergillus fumigatus* beta-glucosidase or variant thereof; and (iv) a *Penicillium* sp. GH61 polypeptide having cellulolytic enhancing activity; or homologs thereof.

122. The blend or composition of any one of paragraphs 117-121, further comprising a trehalase.

123. A recombinant host cell comprising at least one heterologous polynucleotide encoding the polypeptide having pectinase activity of any one of paragraphs 1-6 or 24-56.

124. The recombinant host cell of paragraph 123, wherein the at least one heterologous polynucleotide encoding a polypeptide having pectinase activity encodes at least one, at least two, at least three, at least four, or at least five polypeptides having a different type of pectinase activity of any one of paragraphs 1-6 or 24-56.

125. The recombinant host cell of any one of paragraphs 123-124, wherein the at least one heterologous polynucleotide encoding a polypeptide having pectinase activity is operably linked to a promoter that is foreign to the polynucleotide.

126. The recombinant host cell of any one of paragraphs 123-125, wherein the cell further comprises a heterologous polynucleotide encoding a glucoamylase.

127. The recombinant host cell of paragraph 126, wherein the heterologous polynucleotide encoding the glucoamylase is operably linked to a promoter that is foreign to the polynucleotide.

128. The recombinant host cell of any of paragraphs 123-127, wherein the cell further comprises a heterologous polynucleotide encoding an alpha-amylase.

129. The recombinant host cell of paragraph 128, wherein the heterologous polynucleotide encoding the alpha-amylase is operably linked to a promoter that is foreign to the polynucleotide.

130. The recombinant host cell of any of paragraphs 123-129, wherein the cell further comprises a heterologous polynucleotide encoding a protease.

131. The recombinant host cell of paragraph 130, wherein the heterologous polynucleotide encoding the protease is operably linked to a promoter that is foreign to the polynucleotide.

132. The recombinant host cell of any one of paragraphs 123-131, wherein the cell further comprises a disruption to an endogenous gene encoding a glycerol 3-phosphate dehydrogenase (GPD).

133. The recombinant host cell of any one of paragraphs 123-132, wherein the cell further comprises a disruption to an endogenous gene encoding a glycerol 3-phosphatase (GPP).

134. The recombinant host cell of any one of paragraphs 123-133, wherein the cell is a yeast cell.

135. The recombinant host cell of any one of paragraphs 123-134, wherein the cell is a *Saccharomyces, Rhodotorula, Schizosaccharomyces, Kluyveromyces, Pichia, Hansenula, Rhodosporidium, Candida, Yarrowia, Lipomyces, Cryptococcus*, or *Dekkera* sp. cell.

136. The recombinant host cell of any one of paragraphs 123-135, wherein the cell is a *Saccharomyces cerevisiae* cell.

137. A composition comprising the recombinant host cell of any of paragraphs 123-136 and one or more naturally occurring and/or non-naturally occurring components, such as components are selected from the group consisting of: surfactants, emulsifiers, gums, swelling agents, and antioxidants.

138. Use of a recombinant host cell of any one of paragraphs 123-137 in the production of ethanol.

139. A composition for increasing enzyme accessibility of cellulose fiber in starch-containing or cellulosic-containing material to cellulolytic degradation, comprising at least one, at least two, or at least three polypeptides having pectinase activity of any of the preceding paragraphs.

140. The composition of paragraph 139, wherein the at least two polypeptides having pectinase activity are a polygalacturonase and a pectin methyl esterase.

141. The composition of paragraph 139 or 140, wherein the at least two polypeptides having pectinase activity are a GH28 family polygalacturonase and a CE8 family pectin methyl esterase.

142. The composition of any one of paragraphs 139-141, wherein the at least two polypeptides having pectinase activity are a GH28 family polygalacturonase selected from the group consisting of a polygalacturonase I, a polygalacturonase II, or a polygalacturonase III, and a CE8 family pectin methyl esterase.

143. The composition of any one of paragraphs 139-142, wherein the at least two polypeptides having pectinase activity are a GH28 family polygalacturonase selected from the group consisting of an *Aspergillus* polygalacturonase or a non-naturally occurring variant of an *Aspergillus* polygalacturonase, preferably *Aspergillus aculeatus, Aspergillus luchuensis, Aspergillus niger*, or a strain of *Thermoascus* or is a non-naturally occurring variant of a *Thermoascus* polygalacturonase, preferably *Thermoascus crustaceus*, and a CE8 family pectin methyl esterase from a strain of *Aspergillus* selected from the group consisting of *Aspergillus aculeatus, Aspergillus luchuensis*, and *Aspergillus niger.*

144. The composition of any one of paragraphs 139-143, wherein the at least two polypeptides having pectinase activity are a GH28 family polygalacturonase from a strain of *Aspergillus* and a CE8 family pectin methyl esterase from a strain of *Aspergillus.*

145. The composition of any one of paragraphs 139-144, wherein the at least two polypeptides having pectinase activity are a GH28 family polygalacturonase from a strain of *Aspergillus niger* and a CE8 family pectin methyl esterase from a strain of *Aspergillus niger.*

146. The composition of any one of paragraphs 139-145, wherein the at least two polypeptides having pectinase activity are a GH28 family polygalacturonase comprising, consisting of, or consisting essentially of the mature polypeptide of SEQ ID NO: 2, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to SEQ ID NO: 2 or SEQ ID NO: 3, and a CE8 family pectin methyl esterase comprising, consisting of, or consisting essentially of mature polypeptide of SEQ ID NO: 65, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to SEQ ID NO: 65 or SEQ ID NO: 66.

147. The composition of any one of paragraphs 139-144, wherein the at least two polypeptides having pectinase activity are a GH28 family polygalacturonase from a strain of *Aspergillus niger* and a CE8 family pectin methyl esterase from a strain of *Aspergillus luchuensis.*

148. The composition of any one of paragraphs 139-144 and 147, wherein the at least two polypeptides having pectinase activity are a GH28 family polygalacturonase comprising, consisting of, or consisting essentially of the mature polypeptide of SEQ ID NO: 2, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to SEQ ID NO: 2 or SEQ ID NO: 3, and a CE8 family pectin methyl esterase comprising, consisting of, or consisting essentially of the mature polypeptide of SEQ ID NO: 68, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity or at least 99% identity to SEQ ID NO: 68 or SEQ ID NO: 69.

149. The composition of any one of paragraphs 139-144, wherein the at least two polypeptides having pectinase activity are a GH28 family polygalacturonase from a strain of *Aspergillus aculeatus* and a CE8 family pectin methyl esterase from a strain of *Aspergillus luchuensis.*

150. The composition of any one of paragraphs 139-144 and 149, wherein the at least two polypeptides having pectinase activity are a GH28 family polygalacturonase comprising, consisting of, or consisting essentially the mature polypeptide of SEQ ID NO: 5, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to SEQ ID NO: 5 or SEQ ID NO: 6, and a CE8 family pectin methyl esterase comprising, consisting of, or consisting essentially of the mature polypeptide of SEQ ID NO: 68, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity or at least 99% identity to SEQ ID NO: 68 or SEQ ID NO: 69.

151. The composition of any one of paragraphs 139-144, wherein the at least two polypeptides having pectinase activity are a GH28 family polygalacturonase from a strain of *Aspergillus aculeatus* and a CE8 family pectin methyl esterase from a strain of *Aspergillus niger.*

152. The composition of any one of paragraphs 139-144 and 151, wherein the at least two polypeptides having pectinase activity are a GH28 family polygalacturonase comprising, consisting of, or consisting essentially the mature polypeptide of SEQ ID NO: 5, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to SEQ ID NO: 5 or SEQ ID NO: 6, and a CE8 family pectin methyl esterase comprising, consisting of, or consisting essentially of mature polypeptide of SEQ ID NO: 65, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to SEQ ID NO: 65 or SEQ ID NO: 66

153. The composition of paragraph 139, wherein the at least one polypeptide having pectinase activity is a pectin lyase.

154. The composition of paragraph 139 or 153, wherein the at least one polypeptide having pectinase activity is a pectin lyase from the PL1 family, preferably PL1 subfamily 4.

155. The composition of any one of paragraphs 139 and 153-154, wherein the at least one polypeptide having pectinase activity is a pectin lyase from a strain of *Aspergillus* or is a non-naturally occurring variant of an *Aspergillus* pectin lyase, preferably *Aspergillus luchuensis* or *Aspergillus niger*, or from a strain of *Thielavia* or a non-naturally occurring variant of a *Thielavia* pectin lyase, preferably *Thielavia hyrcaniae.*

156. The composition of paragraph 155, wherein the pectin lyase is selected from the group consisting of:

(i) the mature polypeptide of SEQ ID NO: 77, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to SEQ ID NO: 77 or SEQ ID NO: 78; and (ii) the mature polypeptide of SEQ ID NO: 80, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity or at least 99% identity to SEQ ID NO: 80 or SEQ ID NO: 81;

(iii) the mature polypeptide of SEQ ID NO: 107, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity or at least 99% identity to SEQ ID NO: 107 or SEQ ID NO: 108.

157. The composition of any one of paragraphs 139 and 153-156, wherein the at least one polypeptide having pectinase activity is a pectin lyase from a strain of *Aspergillus*.

158. The composition of any one of paragraphs 139 and 153-157, wherein the at least one polypeptide having pectinase activity is a pectin lyase from a strain of *Aspergillus niger*.

159. The composition of any one of paragraphs 139 and 153-157, wherein the at least one polypeptide having pectinase activity is a pectin lyase comprising, consisting essentially of, or consisting of the mature polypeptide of SEQ ID NO: 107, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity or at least 99% identity to SEQ ID NO: 107 or SEQ ID NO: 108.

160. The composition of any one of paragraphs 139-152, further the at least one polypeptide having pectinase activity is a pectin lyase.

161. The composition of any one of paragraph 139-152 and 160, wherein the at least one polypeptide having pectinase activity is a pectin lyase from the PL1 family, preferably PL1 subfamily 4.

162. The composition of any one of paragraph 139-152 and 160-161, wherein the at least one polypeptide having pectinase activity is a pectin lyase from a strain of *Aspergillus* or is a non-naturally occurring variant of an *Aspergillus* pectin lyase, preferably *Aspergillus luchuensis* or *Aspergillus niger*, or from a strain of *Thielavia* or a non-naturally occurring variant of a *Thielavia* pectin lyase, preferably *Thielavia hyrcaniae*.

163. The composition of paragraph 162, wherein the pectin lyase is selected from the group consisting of:

(i) the mature polypeptide of SEQ ID NO: 77, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to SEQ ID NO: 77 or SEQ ID NO: 78; and (ii) the mature polypeptide of SEQ ID NO: 80, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity or at least 99% identity to SEQ ID NO: 80 or SEQ ID NO: 81;

(iii) the mature polypeptide of SEQ ID NO: 107, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity or at least 99% identity to SEQ ID NO: 107 or SEQ ID NO: 108.

164. The composition of any one of paragraph 139-152 and 160-163, wherein the at least one polypeptide having pectinase activity is a pectin lyase from a strain of *Aspergillus*.

165. The composition of any one of paragraph 139-152 and 160-164, wherein the at least one polypeptide having pectinase activity is a pectin lyase from a strain of *Aspergillus niger*.

166. The composition of any one of paragraph 139-152 and 160-165, wherein the at least one polypeptide having pectinase activity is a pectin lyase comprising, consisting essentially of, or consisting of the mature polypeptide of SEQ ID NO: 107, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity or at least 99% identity to SEQ ID NO: 107 or SEQ ID NO: 108.

167. The composition of any one of paragraphs 139-166 further comprising a cellulolytic composition.

168. The composition of paragraph 167 wherein the cellulolytic composition is as defined in any one of the preceding paragraphs.

169. The composition of paragraph 139-168 further comprising an alpha-amylase and/or a glucoamylase.

170. The composition of paragraph 169 wherein the alpha-amylase and/or glucoamylase is as defined in any one of the preceding paragraphs.

171. The composition of any one of paragraphs 139-170, further comprising a trehalase.

172. The composition of paragraph 171 wherein the trehalase is as defined in any one of the preceding paragraphs.

Materials & Methods

Enzymes Used in the Examples:

Alpha-Amylase A (AAA): *Bacillus stearothermophilus* alpha-amylase of SEQ ID NO: 114 with the mutations I181*+G182*+N193F and truncated to 491 amino acids.

Alpha-Amylase 1407 (AA1407): *Bacillus stearothermophilus* alpha-amylase of SEQ ID NO: 114 with the mutations I181*+G182*+N193F+V59A+Q89R+E129V+K177L+R179E+H208Y+K220P+N224L+Q254S truncated to 491 amino acids.

Alpha-Amylase 369 (AA369): *Bacillus stearothermophilus* alpha-amylase of SEQ ID NO: 114 with the mutations: I181*+G182*+N193F+V59A+Q89R+E129V+K177L+R179E+Q254S+M284V truncated to 491 amino acids.

Alpha-Amylase 2330 (AA2330): *Bacillus stearothermophilus* alpha-amylase with the mutations:—I181*+G182*+V59A+E129V+K177L+R179S+Q254S+M284V+V212T+Y268G+N293Y+T297N+A184Q+E188P+T191N+N193F+S242Y+K279I truncated to 491 amino acids (SEQ ID NO: 114 herein).

Trehalase Tf: *Talaromyces funiculosus* trehalase disclosed herein as SEQ ID NO: 129.

Protease 196: Metallo protease derived from *Thermoascus aurantiacus* CGMCC No. 0670 disclosed as amino acids 1-177 in SEQ ID NO: 77 herein and amino acids 1-177 in SEQ ID NO: 2 in WO 2003/048353 (SEQ ID NO: 115 herein) with the following mutations: A27K+D79L+Y82F+S87G+D104P+A112P+A126V+D142L.

Protease PfuS: Protease derived from *Pyrococcus furiosus* shown in SEQ ID NO: 116 herein Alpha-amylase blend 1: Blend of Amylase AA369 and Protease PfuS.

Alpha-amylase blend 2: Blend of Amylase AA2330 and Protease PfuS.

Glucoamylase BL: Blend comprising *Talaromyces emersonii* glucoamylase disclosed in SEQ ID NO: 124, *Trametes cingulata* glucoamylase disclosed in SEQ ID NO: 123, and *Rhizomucor pusillus* alpha-amylase with *Aspergillus niger* glucoamylase linker and SBD disclosed as SEQ ID NO: 128 with the following substitutions: G128D+D143N (activity ratio AGU:AGU:FAU(F): approx. 30:7:1).

Glucoamylase BL2: Blend comprising *Gloeophyllum sepiarium* glucoamylase disclosed in SEQ ID NO: 126, Trehalase Tf, and *Rhizomucor pusillus* alpha-amylase with *Aspergillus niger* glucoamylase linker and SBD disclosed as SEQ ID NO: 128 with the following substitutions: G128D+D143N (activity ratio AGU:AGU:FAU(F): approx. 30:7:1).

Glucoamylase SA (GSA): Blend comprising *Talaromyces emersonii* glucoamylase disclosed as SEQ ID NO: 34 in WO99/28448 (SEQ ID NO: 124 herein), *Trametes cingulata* glucoamylase disclosed as SEQ ID NO: 2 in WO 06/69289 (SEQ ID NO: 123 herein), and *Rhizomucor pusillus* alpha-amylase with *Aspergillus niger* glucoamylase linker and starch binding domain (SBD) disclosed in SEQ ID NO: 128 herein having the following substitutions G128D+D143N (activity ratio in AGU:AGU:FAU-F is about 20:5:1).

Cellulase 1: Cellulolytic composition derived from *Trichoderma reesei* comprising GH61A polypeptide having cellulolytic enhancing activity derived from a strain of *Penicillium emersonii* (SEQ ID NO: 2 in WO 2011/041397 or SEQ ID NO: 109 herein), *Aspergillus fumigatus* beta-glucosidase (SEQ ID NO: 2 in WO 2005/047499 SEQ ID NO: 110 herein) variant F100D, S283G, N456E, F512Y) disclosed in WO 2012/044915; *Aspergillus fumigatus* Cel7A CBH1 disclosed as SEQ ID NO: 6 in WO2011/057140 (SEQ ID NO: 111 herein) and *Aspergillus fumigatus* CBH II disclosed as SEQ ID NO: 18 in WO 2011/057140 (SEQ ID NO: 112 herein).

Cellulase 2: Cellulolytic composition derived from *Trichoderma reesei* comprising *Aspergillus fumigatus* beta-glucosidase (SEQ ID NO: 2 in WO 2005/047499 SEQ ID NO: 110 herein) variant F100D, S283G, N456E, F512Y) disclosed in WO 2012/044915; *Aspergillus fumigatus* Cel7A CBH1 disclosed as SEQ ID NO: 6 in WO2011/057140 (SEQ ID NO: 111 herein) and *Trichoderma reesei* endoglucanase 1 (Tr EG1) disclosed as SEQ ID NO: 113 herein.

Pectinase 1: Pectinolytic composition derived from *Aspergillus niger* comprising: *Aspergillus niger* endo-polygalacturonase GH28 disclosed as SEQ ID NO: 3 herein (P334J3 in FIG. 2); *Aspergillus niger* pectin methyl esterase CE8 disclosed as SEQ ID NO: 66 herein (P334HP in FIG. 2).

Pectinase 2: Pectinolytic composition derived from *Aspergillus niger* comprising: *Aspergillus niger* pectin lyase PL1_4 disclosed as SEQ ID NO: 108 (P65U in FIG. 2).

Pectinase 3: Pectinolytic composition comprising PL4_1 family rhamnogalacturonan lyase from *Sporormia fimetaria* disclosed as SEQ ID NO: 141, a PL1_4 family pectin lyase from *Thielavia hyrcaniae* disclosed as SEQ ID NO: 77, and a GH28 family polygalacturonase from *Penicillium oxalicum* disclosed as SEQ ID NO: 144.

Pectin Methyl esterase (AlPME): CE8 family pectin methyl esterase from *Aspergillus luchuensis* disclosed as SEQ ID NO: 69 herein (P34HQ6 in FIG. 2).

Polygalacturonase GH28 (AaPG): GH28 polygalacturonase from *Aspergillus aculeatus* disclosed as SEQ ID NO: 6 herein (P449U1 in FIG. 2).

Pectin Lyase A (AnPLA): Pectin lyase A from *Aspergillus niger* disclosed as SEQ ID NO: 108 herein (P65U in FIG. 2).

SEQ ID NO: 53: GH28 family rhamnogalacturonase from *Talaromyces calidicanius.*

SEQ ID NO: 147: GH28 family rhamnogalacturonase from *Talaromyces* sp. X2925.

Yeast: RED STAR ETHANOL RED™ available from Leaf, France.

Protease Assays

AZCL-Casein Assay

A solution of 0.2% of the blue substrate AZCL-casein is suspended in Borax/$NaH_2PO_4$ buffer pH9 while stirring. The solution is distributed while stirring to microtiter plate (100 microL to each well), 30 microL enzyme sample is added and the plates are incubated in an Eppendorf Thermomixer for 30 minutes at 45° C. and 600 rpm. Denatured enzyme sample (100° C. boiling for 20 min) is used as a blank. After incubation the reaction is stopped by transferring the microtiter plate onto ice and the coloured solution is separated from the solid by centrifugation at 3000 rpm for 5 minutes at 4° C. 60 microL of supernatant is transferred to a microtiter plate and the absorbance at 595 nm is measured using a BioRad Microplate Reader.

pNA-Assay 50 microL protease-containing sample is added to a microtiter plate and the assay is started by adding 100 microL 1 mM pNA substrate (5 mg dissolved in 100 microL DMSO and further diluted to 10 mL with Borax/$NaH_2PO_4$ buffer pH 9.0). The increase in $OD_{405}$ at room temperature is monitored as a measure of the protease activity.

Glucoamylase Activity (AGU)

Glucoamylase activity may be measured in Glucoamylase Units (AGU).

The Novo Glucoamylase Unit (AGU) is defined as the amount of enzyme, which hydrolyzes 1 micromole maltose per minute under the standard conditions 37° C., pH 4.3, substrate: maltose 23.2 mM, buffer: acetate 0.1 M, reaction time 5 minutes.

An autoanalyzer system may be used. Mutarotase is added to the glucose dehydrogenase reagent so that any alpha-D-glucose present is turned into beta-D-glucose. Glucose dehydrogenase reacts specifically with beta-D-glucose in the reaction mentioned above, forming NADH which is determined using a photometer at 340 nm as a measure of the original glucose concentration.

| AMG incubation: | |
|---|---|
| Substrate: | maltose 23.2 mM |
| Buffer: | acetate 0.1M |
| pH: | 4.30 ± 0.05 |
| Incubation temperature: | 37° C. ± 1 |
| Reaction time: | 5 minutes |
| Enzyme working range: | 0.5-4.0 AGU/mL |

| Color reaction: | |
|---|---|
| GlucDH: | 430 U/L |
| Mutarotase: | 9 U/L |
| NAD: | 0.21 mM |
| Buffer: | phosphate 0.12M; 0.15M NaCl |
| pH: | 7.60 ± 0.05 |
| Incubation temperature: | 37° C. ± 1 |
| Reaction time: | 5 minutes |
| Wavelength: | 340 nm |

A folder (EB-SM-0131.02/01) describing this analytical method in more detail is available on request from Novozymes A/S, Denmark, which folder is hereby included by reference.

Acid Alpha-Amylase Activity (AFAU)

Acid alpha-amylase activity may be measured in AFAU (Acid Fungal Alpha-amylase Units), which are determined relative to an enzyme standard. 1 AFAU is defined as the amount of enzyme which degrades 5.260 mg starch dry matter per hour under the below mentioned standard conditions.

Acid alpha-amylase, an endo-alpha-amylase (1,4-alpha-D-glucan-glucanohydrolase, E.C. 3.2.1.1) hydrolyzes alpha-1,4-glucosidic bonds in the inner regions of the starch molecule to form dextrins and oligosaccharides with different chain lengths. The intensity of color formed with iodine is directly proportional to the concentration of starch. Amylase activity is determined using reverse colorimetry as a reduction in the concentration of starch under the specified analytical conditions.

$$\text{STARCH} + \text{IODINE} \xrightarrow[40°,\ \text{pH } 2.5]{\text{ALPHA-AMYLASE}} \text{DEXTRINS} + \text{OLIGOSACCHARIDES}$$

$\lambda = 590$ nm blue/violet t=23 sec. decoloration

Standard Conditions/Reaction Conditions:

| | |
|---|---|
| Substrate: | Soluble starch, approx. 0.17 g/L |
| Buffer: | Citrate, approx. 0.03M |
| Iodine (I2): | 0.03 g/L |
| CaCl2: | 1.85 mM |
| pH: | 2.50 ± 0.05 |
| Incubation temperature: | 40° C. |

-continued

| | |
|---|---|
| Reaction time: | 23 seconds |
| Wavelength: | 590 nm |
| Enzyme concentration: | 0.025 AFAU/mL |
| Enzyme working range: | 0.01-0.04 AFAU/mL |

A folder EB-SM-0259.02/01 describing this analytical method in more detail is available upon request to Novozymes A/S, Denmark, which folder is hereby included by reference.

Alpha-Amylase Activity (KNU)

The alpha-amylase activity may be determined using potato starch as substrate. This method is based on the break-down of modified potato starch by the enzyme, and the reaction is followed by mixing samples of the starch/enzyme solution with an iodine solution. Initially, a blackish-blue color is formed, but during the break-down of the starch the blue color gets weaker and gradually turns into a reddish-brown, which is compared to a colored glass standard.

One Kilo Novo alpha amylase Unit (KNU) is defined as the amount of enzyme which, under standard conditions (i.e., at 37° C.+/−0.05; 0.0003 M $Ca^{2+}$; and pH 5.6) dextrinizes 5260 mg starch dry substance Merck Amylum solubile.

A folder EB-SM-0009.02/01 describing this analytical method in more detail is available upon request to Novozymes A/S, Denmark, which folder is hereby included by reference.

Determination of FAU(F)

FAU(F) Fungal Alpha-Amylase Units (Fungamyl) is measured relative to an enzyme standard of a declared strength.

| Reaction conditions | |
|---|---|
| Temperature | 37° C. |
| pH | 7.15 |
| Wavelength | 405 nm |
| Reaction time | 5 min |
| Measuring time | 2 min |

A folder (EB-SM-0216.02) describing this standard method in more detail is available on request from Novozymes A/S, Denmark, which folder is hereby included by reference.

Determination of Pullulanase Activity (NPUN)

Endo-pullulanase activity in NPUN is measured relative to a Novozymes pullulanase standard. One pullulanase unit (NPUN) is defined as the amount of enzyme that releases 1 micro mol glucose per minute under the standard conditions (0.7% red pullulan (Megazyme), pH 5, 40° C., 20 minutes). The activity is measured in NPUN/ml using red pullulan.

1 mL diluted sample or standard is incubated at 40° C. for 2 minutes. 0.5 mL 2% red pullulan, 0.5 M KCl, 50 mM citric acid, pH 5 are added and mixed. The tubes are incubated at 40° C. for 20 minutes and stopped by adding 2.5 ml 80% ethanol. The tubes are left standing at room temperature for 10-60 minutes followed by centrifugation 10 minutes at 4000 rpm. OD of the supernatants is then measured at 510 nm and the activity calculated using a standard curve.

The present invention is described in further detail in the following examples which are offered to illustrate the present invention, but not in any way intended to limit the scope of the invention as claimed. All references cited herein are specifically incorporated by reference for that which is described therein.

Enzymatic Hydrolysis of Corn Kernel Fiber

Enzymatic hydrolysis is done by combining 500 mg of a dry mill ethanol whole stillage, 50 μg of appropriately diluted sample of cellulase 1, 0.3 Amyloglucosidase Units (AGU) of appropriately diluted sample of Glucoamylase SA.

EXAMPLES

Example 1

Stability of Alpha-Amylase Variants

The stability of a reference alpha-amylase (*Bacillus stearothermophilus* alpha-amylase with the mutations I181*+G182*+N193F truncated to 491 amino acids (using SEQ ID NO: 126 for numbering)) and alpha-amylase variants thereof was determined by incubating the reference alpha-amylase and variants at pH 4.5 and 5.5 and temperatures of 75° C. and 85° C. with 0.12 mM $CaCl_2$ followed by residual activity determination using the EnzChek® substrate (EnzChek® Ultra Amylase assay kit, E33651, Molecular Probes).

Polypeptide enzyme samples were diluted to working concentrations of 0.5 and 1 or 5 and 10 ppm (micrograms/ml) in enzyme dilution buffer (10 mM acetate, 0.01% Triton X100, 0.12 mM $CaCl_2$, pH 5.0). Twenty microliters enzyme sample was transferred to 48-well PCR MTP and 180 microliters stability buffer (150 mM acetate, 150 mM MES, 0.01% Triton X100, 0.12 mM $CaCl_2$, pH 4.5 or 5.5) was added to each well and mixed. The assay was performed using two concentrations of enzyme in duplicates. Before incubation at 75° C. or 85° C., 20 microliters was withdrawn and stored on ice as control samples. Incubation was performed in a PCR machine at 75° C. and 85° C. After incubation samples were diluted to 15 ng/mL in residual activity buffer (100 mM Acetate, 0.01% Triton X100, 0.12 mM $CaCl_2$, pH 5.5) and 25 microliters diluted enzyme was transferred to black 384-MTP. Residual activity was determined using the EnzChek substrate by adding 25 microliters substrate solution (100 micrograms/ml) to each well. Fluorescence was determined every minute for 15 minutes using excitation filter at 485-P nm and emission filter at 555 nm (fluorescence reader is Polarstar, BMG). The residual activity was normalized to control samples for each setup.

Assuming logarithmic decay half life time (T½ (min)) was calculated using the equation: T½ (min)=T(min)*LN (0.5)/LN(% RA/100), where T is assay incubation time in minutes, and % RA is % residual activity determined in assay.

Using this assay setup the half life time was determined for the reference alpha-amylase and variant thereof as shown in Table 1.

TABLE 1

| Mutations | $T_{1/2}$ (min) (pH 4.5, 75° C., 0.12 mM $CaCl_2$) | $T_{1/2}$ (min) (pH 4.5, 85° C., 0.12 mM $CaCl_2$) | $T_{1/2}$ (min) (pH 5.5, 85° C., 0.12 mM $CaCl_2$) |
|---|---|---|---|
| Reference Alpha-Amylase A | 21 | 4 | 111 |
| Reference Alpha-Amylase A with the substitution V59A | 32 | 6 | 301 |
| Reference Alpha-Amylase A with the substitution V59E | 28 | 5 | 230 |
| Reference Alpha-Amylase A with the substitution V59I | 28 | 5 | 210 |
| Reference Alpha-Amylase A with the substitution V59Q | 30 | 6 | 250 |
| Reference Alpha-Amylase A with the substitutions V59A + Q89R + G112D + E129V + K177L + R179E + K220P + N224L + Q254S | 149 | 22 | ND |
| Reference Alpha-Amylase A with the substitutions V59A + Q89R + E129V + K177L + R179E + H208Y + K220P + N224L + Q254S | >180 | 28 | ND |
| Reference Alpha-Amylase A with the substitutions V59A + Q89R + E129V + K177L + R179E + K220P + N224L + Q254S + D269E + D281N | 112 | 16 | ND |
| Reference Alpha-Amylase A with the substitutions V59A + Q89R + E129V + K177L + R179E + K220P + N224L + Q254S + I270L | 168 | 21 | ND |
| Reference Alpha-Amylase A with the substitutions V59A + Q89R + E129V + K177L + R179E + K220P + N224L + Q254S + H274K | >180 | 24 | ND |
| Reference Alpha-Amylase A with the substitutions V59A + Q89R + E129V + K177L + R179E + K220P + N224L + Q254S + Y276F | 91 | 15 | ND |
| Reference Alpha-Amylase A with the substitutions V59A + E129V + R157Y + K177L + R179E + K220P + N224L + S242Q + Q254S | 141 | 41 | ND |
| Reference Alpha-Amylase A with the substitutions V59A + E129V + K177L + R179E + H208Y + K220P + N224L + S242Q + Q254S | >180 | 62 | ND |
| Reference Alpha-Amylase A with the substitutions V59A + E129V + K177L + R179E + K220P + N224L + S242Q + Q254S | >180 | 49 | >480 |
| Reference Alpha-Amylase A with the substitutions V59A + E129V + K177L + R179E + K220P + N224L + S242Q + Q254S + H274K | >180 | 53 | ND |
| Reference Alpha-Amylase A with the substitutions V59A + E129V + K177L + R179E + K220P + N224L + S242Q + Q254S + Y276F | >180 | 57 | ND |
| Reference Alpha-Amylase A with the substitutions V59A + E129V + K177L + R179E + K220P + N224L + S242Q + Q254S + D281N | >180 | 37 | ND |
| Reference Alpha-Amylase A with the substitutions V59A + E129V + K177L + R179E + K220P + N224L + S242Q + Q254S + M284T | >180 | 51 | ND |
| Reference Alpha-Amylase A with the substitutions V59A + E129V + K177L + R179E + K220P + N224L + S242Q + Q254S + G416V | >180 | 45 | ND |
| Reference Alpha-Amylase A with the substitutions V59A + E129V + K177L + R179E + K220P + N224L + Q254S | 143 | 21 | >480 |
| Reference Alpha-Amylase A with the substitutions V59A + E129V + K177L + R179E + K220P + N224L + Q254S + M284T | >180 | 22 | ND |

TABLE 1-continued

| Mutations | $T_{1/2}$ (min) (pH 4.5, 75° C., 0.12 mM $CaCl_2$) | $T_{1/2}$ (min) (pH 4.5, 85° C., 0.12 mM $CaCl_2$) | $T_{1/2}$ (min) (pH 5.5, 85° C., 0.12 mM $CaCl_2$) |
|---|---|---|---|
| Reference Alpha-Amylase A with the substitutions A91L + M96I + E129V + K177L + R179E + K220P + N224L + S242Q + Q254S | >180 | 38 | ND |
| Reference Alpha-Amylase A with the substitutions E129V + K177L + R179E | 57 | 11 | 402 |
| Reference Alpha-Amylase A with the substitutions E129V + K177L + R179E + K220P + N224L + S242Q + Q254S | 174 | 44 | >480 |
| Reference Alpha-Amylase A with the substitutions E129V + K177L + R179E + K220P + N224L + S242Q + Q254S + Y276F + L427M | >180 | 49 | >480 |
| Reference Alpha-Amylase A with the substitutions E129V + K177L + R179E + K220P + N224L + S242Q + Q254S + M284T | >180 | 49 | >480 |
| Reference Alpha-Amylase A with the substitutions E129V + K177L + R179E + K220P + N224L + S242Q + Q254S + N376* + I377* | 177 | 36 | >480 |
| Reference Alpha-Amylase A with the substitutions E129V + K177L + R179E + K220P + N224L + Q254S | 94 | 13 | >480 |
| Reference Alpha-Amylase A with the substitutions E129V + K177L + R179E + K220P + N224L + Q254S + M284T | 129 | 24 | >480 |
| Reference Alpha-Amylase A with the substitutions E129V + K177L + R179E + S242Q | 148 | 30 | >480 |
| Reference Alpha-Amylase A with the substitutions E129V + K177L + R179V | 78 | 9 | >480 |
| Reference Alpha-Amylase A with the substitutions E129V + K177L + R179V + K220P + N224L + S242Q + Q254S | 178 | 31 | >480 |
| Reference Alpha-Amylase A with the substitutions K220P + N224L + S242Q + Q254S | 66 | 17 | >480 |
| Reference Alpha-Amylase A with the substitutions K220P + N224L + Q254S | 30 | 6 | 159 |
| Reference Alpha-Amylase A with the substitution M284T | 35 | 7 | 278 |
| Reference Alpha-Amylase A with the substitutions M284V | 59 | 13 | ND |

ND not determined

The results demonstrate that the alpha-amylase variants have a significantly greater half-life and stability than the reference alpha-amylase.

Example 2

Preparation of Protease Variants and Test of Thermostability

Strains and Plasmids

*E. coli* DH12S (available from Gibco BRL) was used for yeast plasmid rescue. pJTP000 is a *S. cerevisiae* and *E. coli* shuttle vector under the control of TPI promoter, constructed from pJC039 described in WO 01/92502, in which the *Thermoascus aurantiacus* M35 protease gene (WO 03048353) has been inserted.

*Saccharomyces cerevisiae* YNG318 competent cells: MATa Dpep4[cir+] ura3-52, leu2-D2, his 4-539 was used for protease variants expression. It is described in J. Biol. Chem. 272 (15), pp 9720-9727, 1997.

Media and Substrates

10× Basal solution: Yeast nitrogen base w/o amino acids (DIFCO) 66.8 g/l, succinate 100 g/l, NaOH 60 g/l.

SC-glucose: 20% glucose (i.e., a final concentration of 2%=2 g/100 ml)) 100 ml/l, 5% threonine 4 ml/l, 1% tryptophan 10 ml/l, 20% casamino acids 25 ml/l, 10× basal solution 100 ml/l. The solution is sterilized using a filter of a pore size of 0.20 micrometer. Agar (2%) and $H_2O$ (approx. 761 ml) is autoclaved together, and the separately sterilized SC-glucose solution is added to the agar solution.

YPD: Bacto peptone 20 g/l, yeast extract 10 g/l, 20% glucose 100 ml/l.

YPD+Zn: YPD+0.25 mM $ZnSO_4$.

PEG/LiAc solution: 40% PEG4000 50 ml, 5 M Lithium Acetate 1 ml.

96 well Zein micro titre plate:

Each well contains 200 microL of 0.05-0.1% of zein (Sigma), 0.25 mM $ZnSO_4$ and 1% of agar in 20 mM sodium acetate buffer, pH 4.5.

DNA Manipulations

Unless otherwise stated, DNA manipulations and transformations were performed using standard methods of molecular biology as described in Sambrook et al. (1989) Molecular cloning: A laboratory manual, Cold Spring Harbor lab. Cold Spring Harbor, NY; Ausubel, F. M. et al. (eds.) "*Current protocols in Molecular Biology*", John Wiley and Sons, 1995; Harwood, C. R. and Cutting, S. M. (Eds.).

Yeast Transformation

Yeast transformation was performed using the lithium acetate method. 0.5 microL of vector (digested by restriction endonucleases) and 1 microL of PCR fragments is mixed. The DNA mixture, 100 microL of YNG318 competent cells, and 10 microL of YEAST MAKER carrier DNA (Clontech) is added to a 12 ml polypropylene tube (Falcon 2059). Add 0.6 ml PEG/LiAc solution and mix gently. Incubate for 30 min at 30° C., and 200 rpm followed by 30 min at 42° C. (heat shock). Transfer to an eppendorf tube and centrifuge for 5 sec. Remove the supernatant and resolve in 3 ml of YPD. Incubate the cell suspension for 45 min at 200 rpm at 30° C. Pour the suspension to SC-glucose plates and incubate 30° C. for 3 days to grow colonies. Yeast total DNA are extracted by Zymoprep Yeast Plasmid Miniprep Kit (ZYMO research).

DNA Sequencing

*E. coli* transformation for DNA sequencing was carried out by electroporation (BIO-RAD Gene Pulser). DNA Plasmids were prepared by alkaline method (Molecular Cloning, Cold Spring Harbor) or with the Qiagen® Plasmid Kit. DNA fragments were recovered from agarose gel by the Qiagen gel extraction Kit. PCR was performed using a PTC-200 DNA Engine. The ABI PRISM™ 310 Genetic Analyzer was used for determination of all DNA sequences.

Construction of Protease Expression Vector

The *Thermoascus* M35 protease gene was amplified with the primer pair Prot F and Prot R. The resulting PCR fragments were introduced into *S. cerevisiae* YNG318 together with the pJC039 vector (described in WO 2001/92502) digested with restriction enzymes to remove the *Humicola insolens* cutinase gene.

The Plasmid in yeast clones on SC-glucose plates was recovered to confirm the internal sequence and termed as pJTP001.

Construction of Yeast Library and Site-Directed Variants

Library in yeast and site-directed variants were constructed by SOE PCR method (Splicing by Overlap Extension, see "PCR: A practical approach", p. 207-209, Oxford University press, eds. McPherson, Quirke, Taylor), followed by yeast in vivo recombination.

General Primers for Amplification and Sequencing

The primers AM34 and AM35 were used to make DNA fragments containing any mutated fragments by the SOE method together with degenerated primers (AM34+Reverse primer and AM35+forward primer) or just to amplify a whole protease gene (AM34+AM35).

| PCR reaction system: | | Conditions: |
|---|---|---|
| 48.5 microL $H_2O$ | 1 | 94° C. 2 min |
| 2 beads puRe Taq Ready-To-Go PCR (Amersham Biosciences) | 2 | 94° C. 30 sec |
| 0.5 micro L × 2 100 pmole/microL of primers | 3 | 55° C. 30 sec |
| 0.5 microL template DNA | 4 | 72° C. 90 sec |
| | 2-4 | 25 cycles |
| | 5 | 72° C. 10 min |

DNA fragments were recovered from agarose gel by the Qiagen gel extraction Kit. The resulting polypeptide fragments were mixed with the vector digest. The mixed solution was introduced into *Saccharomyces cerevisiae* to construct libraries or site-directed variants by in vivo recombination.

Relative Activity Assay

Yeast clones on SC-glucose were inoculated to a well of a 96-well micro titre plate containing YPD+Zn medium and cultivated at 28° C. for 3 days. The culture supernatants were applied to a 96-well zein micro titer plate and incubated at at least 2 temperatures (ex. 60° C. and 65° C., 70° C. and 75° C., 70° C. and 80° C.) for more than 4 hours or overnight. The turbidity of zein in the plate was measured as A630 and the relative activity (higher/lower temperatures) was determined as an indicator of thermoactivity improvement. The clones with higher relative activity than the parental variant were selected and the sequence was determined.

Remaining Activity Assay

Yeast clones on SC-glucose were inoculated to a well of a 96-well micro titre plate and cultivated at 28° C. for 3 days. Protease activity was measured at 65° C. using azo-casein (Megazyme) after incubating the culture supernatant in 20 mM sodium acetate buffer, pH 4.5, for 10 min at a certain temperature (80° C. or 84° C. with 4° C. as a reference) to determine the remaining activity. The clones with higher remaining activity than the parental variant were selected and the sequence was determined.

Azo-Casein Assay 20 microL of samples were mixed with 150 microL of substrate solution (4 ml of 12.5% azo-casein in ethanol in 96 ml of 20 mM sodium acetate, pH 4.5, containing 0.01% triton-100 and 0.25 mM $ZnSO_4$) and incubated for 4 hours or longer.

After adding 20 microL/well of 100% trichloroacetic acid (TCA) solution, the plate was centrifuge and 100 microL of supernatants were pipette out to measure A440.

Expression of Protease Variants in *Aspergillus oryzae*

The constructs comprising the protease variant genes were used to construct expression vectors for *Aspergillus*. The *Aspergillus* expression vectors consist of an expression cassette based on the *Aspergillus niger* neutral amylase II promoter fused to the *Aspergillus nidulans* triose phosphate isomerase non translated leader sequence (Pna2/tpi) and the *Aspergillus niger* amyloglucosidase terminator (Tamg). Also present on the plasmid was the *Aspergillus* selective marker amdS from *Aspergillus nidulans* enabling growth on acetamide as sole nitrogen source. The expression plasmids for protease variants were transformed into *Aspergillus* as described in Lassen et al. (2001), *Appl. Environ. Microbiol.* 67, 4701-4707. For each of the constructs 10-20 strains were isolated, polypeptide and cultivated in shake flasks.

Purification of Expressed Variants

1. Adjust pH of the 0.22 μm filtered fermentation sample to 4.0.
2. Put the sample on an ice bath with magnetic stirring. Add (NH4)2SO4 in small aliquots (corresponding to approx. 2.0-2.2 M (NH4)2SO4 not taking the volume increase into account when adding the compound).
3. After the final addition of (NH4)2SO4, incubate the sample on the ice bath with gentle magnetic stirring for min. 45 min.
4. Centrifugation: Hitachi himac CR20G High-Speed Refrigerated Centrifuge equipped with R20A2 rotor head, 5° C., 20,000 rpm, 30 min.
5. Dissolve the formed precipitate in 200 ml 50 mM Na-acetate pH 4.0.
6. Filter the sample by vacuum suction using a 0.22 μm PES PLUS membrane (IWAKI).
7. Desalt/buffer-exchange the sample to 50 mM Na-acetate pH 4.0 using ultrafiltration (Vivacell 250 from Vivascience equipped with 5 kDa MWCO PES membrane) overnight in a cold room. Dilute the retentate sample to 200 ml using 50 mM Na-acetate pH 4.0. The conductivity of sample is preferably less than 5 mS/cm.
8. Load the sample onto a cation-exchange column equilibrated with 50 mM Na-acetate pH 4.0. Wash unbound sample out of the column using 3 column volumes of binding buffer (50 mM Na-acetate pH 4.0), and elute the sample using a linear gradient, 0-100% elution buffer (50 mM Na-acetate+1 M NaCl pH 4.0) in 10 column volumes.
9. The collected fractions are assayed by an endo-protease assay (cf. below) followed by standard SDS-PAGE (reducing conditions) on selected fractions. Fractions are pooled based on the endo-protease assay and SDS-PAGE.

Endo-Protease Assay

1. Protazyme OL tablet/5 ml 250 mM Na-acetate pH 5.0 is dissolved by magnetic stirring (substrate: endo-protease Protazyme AK tablet from Megazyme—cat. #PRAK 11/08).
2. With stirring, 250 microL of substrate solution is transferred to a 1.5 ml Eppendorf tube.
3. 25 microL of sample is added to each tube (blank is sample buffer).
4. The tubes are incubated on a Thermomixer with shaking (1000 rpm) at 50° C. for 15 minutes.
5. 250 microL of 1 M NaOH is added to each tube, followed by vortexing.
6. Centrifugation for 3 min. at 16,100×G and 2500.
7. 200 microL of the supernatant is transferred to a MTP, and the absorbance at 590 nm is recorded.

Results

TABLE 2

Relative activity of protease variants. Numbering of substitution(s) starts from N-terminal of the mature peptide in amino acids 1 to 177 of SEQ ID NO: 127.

| Variant | Substitution(s) | Relative activity 65° C./60° C. |
|---|---|---|
| WT | none | 31% |
| JTP004 | S87P | 45% |
| JTP005 | A112P | 43% |
| JTP008 | R2P | 71% |
| JTP009 | D79K | 69% |
| JTP010 | D79L | 75% |
| JTP011 | D79M | 73% |
| JTP012 | D79L/S87P | 86% |
| JTP013 | D79L/S87P/A112P | 90% |
| JTP014 | D79L/S87P/A112P | 88% |
| JTP016 | A73C | 52% |
| JTP019 | A126V | 69% |
| JTP021 | M152R | 59% |

TABLE 3

Relative activity of protease variants. Numbering of substitution(s) starts from N-terminal of the mature peptide in amino acids 1 to 177 of SEQ ID NO: 127.

| | | Relative activity | | |
|---|---|---|---|---|
| Variant | Substitution(s) and/or deletion (S) | 70° C./ 65° C. | 75° C./ 65° C. | 75° C./ 70° C. |
| WT | none | 59% | 17% | |
| JTP036 | D79L/S87P/D142L | 73% | 73% | |
| JTP040 | T54R/D79L/S87P | | 71% | |
| JTP042 | Q53K/D79L/S87P/I173V | | 108% | |
| JTP043 | Q53R/D79L/S87P | | 80% | |
| JTP045 | S41R/D79L/S87P | | 82% | |
| JTP046 | D79L/S87P/Q158W | | 96% | |
| JTP047 | D79L/S87P/S157K | | 85% | |
| JTP048 | D79L/S87P/D104R | | 88% | |
| JTP050 | D79L/S87P/A112P/D142L | | 88% | |
| JTP051 | S41R/D79L/S87P/A112P/D142L | | | 102% |
| JTP052 | D79L/S87P/A112P/D142L/S157K | | | 111% |
| JTP053 | S41R/D79L/S87P/A112P/D142L/ S157K | | | 113% |
| JTP054 | ΔS5/D79L/S87P | | | 92% |
| JTP055 | ΔG8/D79L/S87P | | | 95% |
| JTP059 | C6R/D79L/S87P | | | 92% |
| JTP061 | T46R/D79L/S87P | | | 111% |
| JTP063 | S49R/D79L/S87P | | | 94% |
| JTP064 | D79L/S87P/N88R | | | 92% |
| JTP068 | D79L/S87P/T114P | | | 99% |
| JTP069 | D79L/S87P/S115R | | | 103% |
| JTP071 | D79L/S87P/T116V | | | 105% |
| JTP072 | N26R/D79L/S87P | | 92% | |
| JTP077 | A27K/D79L/S87P/A112P/ D142L | | 106% | |
| JTP078 | A27V/D79L/S87P/A112P/ D142L | | 100% | |
| JTP079 | A27G/D79L/S87P/A112P/ D142L | | 104% | |

TABLE 4

Relative activity of protease variants. Numbering of substitution(s) starts from N-terminal of the mature peptide in amino acids 1 to 177 of SEQ ID NO: 127.

| | | Relative activity | Remaining activity | |
|---|---|---|---|---|
| Variant | Substitution(s) and/or deletion(s) | 75° C./ 65° C. | 80° C. | 84° C. |
| JTP082 | ΔS5/D79L/S87P/A112P/D142L | 129% | | 53% |
| JTP083 | T46R/D79L/S87P/A112P/D142L | 126% | | |
| JTP088 | Y43F/D79L/S87P/A112P/D142L | 119% | | |
| JTP090 | D79L/S87P/A112P/T124L/D142L | 141% | | |
| JTP091 | D79L/S87P/A112P/T124V/D142L | 154% | 43% | |
| JTP092 | ΔS5/N26R/D79L/S87P/A112P/ D142L | | | 60% |
| JTP095 | N26R/T46R/D79L/S87P/A112P/ D142L | | | 62% |
| JTP096 | T46R/D79L/S87P/T116V/D142L | | | 67% |
| JTP099 | D79L/P81R/S87P/A112P/D142L | | | 80% |
| JTP101 | A27K/D79L/S87P/A112P/T124V/ D142L | | 81% | |
| JTP116 | D79L/Y82F/S87P/A112P/T124V/ D142L | | 59% | |
| JTP117 | D79L/Y82F/S87P/A112P/T124V/ D142L | | 94% | |
| JTP127 | D79L/S87P/A112P/T124V/A126V/ D142L | | 53% | |

TABLE 5

Relative activity of protease variants. Numbering of substitution(s) starts from N-terminal of the mature peptide in amino acids 1 to 177 of SEQ ID NO: 127.

| | | Relative activity | | |
|---|---|---|---|---|
| Variant | Substitutions | 75° C./ 70° C. | 80° C./ 70° C. | 85° C./ 70° C. |
| JTP050 | D79L S87P A112P D142L | 55% | 23% | 9% |
| JTP134 | D79L Y82F S87P A112P D142L | | 40% | |
| JTP135 | S38T D79L S87P A112P A126V D142L | | 62% | |
| JTP136 | D79L Y82F S87P A112P A126V D142L | | 59% | |
| JTP137 | A27K D79L S87P A112P A126V D142L | | 54% | |
| JTP140 | D79L S87P N98C A112P G135C D142L | 81% | | |
| JTP141 | D79L S87P A112P D142L T141C M161C | 68% | | |
| JTP143 | S36P D79L S87P A112P D142L | 69% | | |
| JTP144 | A37P D79L S87P A112P D142L | 57% | | |
| JTP145 | S49P D79L S87P A112P D142L | 82% | 59% | |
| JTP146 | S50P D79L S87P A112P D142L | 83% | 63% | |
| JTP148 | D79L S87P D104P A112P D142L | 76% | 64% | |
| JTP161 | D79L Y82F S87G A112P D142L | | 30% | 12% |
| JTP180 | S70V D79L Y82F S87G Y97W A112P D142L | | 52% | |
| JTP181 | D79L Y82F S87G Y97W D104P A112P D142L | | 45% | |
| JTP187 | S70V D79L Y82F S87G A112P D142L | | 45% | |
| JTP188 | D79L Y82F S87G D104P A112P D142L | | 43% | |
| JTP189 | D79L Y82F S87G A112P A126V D142L | | 46% | |
| JTP193 | Y82F S87G S70V D79L D104P A112P D142L | | | 15% |
| JTP194 | Y82F S87G D79L D104P A112P A126V D142L | | | 22% |
| JTP196 | A27K D79L Y82F S87G D104P A112P A126V D142L | | | 18% |

TABLE 6

| Relative activity of protease variants. Numbering of substitution(s) starts from N-terminal of the mature peptide in amino acids 1 to 177 of SEQ ID NO: 127. | | | |
|---|---|---|---|
| | | Relative activity | |
| Variant | Substitutions | 75° C./70° C. | 80° C./70° C. |
| JTP196 | A27K D79L Y82F S87G D104P A112P A126V D142L | 102% | 55% |
| JTP210 | A27K Y82F S87G D104P A112P A126V D142L | 107% | 36% |
| JTP211 | A27K D79L Y82F D104P A112P A126V D142L | 94% | 44% |
| JTP213 | A27K Y82F D104P A112P A126V D142L | 103% | 37% |

Example 3

Temperature Profile of Selected Variants Using Polypeptide Enzymes

Selected variants showing good thermo-stability were polypeptide and the polypeptide enzymes were used in a zein-BCA assay as described below. The remaining protease activity was determined at 60° C. after incubation of the enzyme at elevated temperatures as indicated for 60 min.

Zein-BCA Assay:

Zein-BCA assay was performed to detect soluble protein quantification released from zein by variant proteases at various temperatures.

Protocol:

1□ Mix 10 ul of 10 ug/ml enzyme solutions and 100 ul of 0.025% zein solution in a micro titer plate (MTP).

2□ Incubate at various temperatures for 60 min.

3□ Add 10 ul of 100% trichloroacetic acid (TCA) solution.

4□ Centrifuge MTP at 3500 rpm for 5 min.

5□ Take out 15 ul to a new MTP containing 100 ul of BCA assay solution (Pierce Cat #: 23225, BCA Protein Assay Kit).

6□ Incubate for 30 min. at 60° C.

7□ Measure A562.

The results are shown in Table 7. All of the tested variants showed an improved thermo-stability as compared to the wt protease.

TABLE 7

| Zein-BCA assay | | | | | | | |
|---|---|---|---|---|---|---|---|
| | Sample incubated 60 min at indicated temperatures (° C.) (µg/ml Bovine serum albumin equivalent peptide released) | | | | | | |
| WT/Variant | 60° C. | 70° C. | 75° C. | 80° C. | 85° C. | 90° C. | 95° C. |
| WT | 94 | 103 | 107 | 93 | 58 | 38 | |
| JTP050 | 86 | 101 | 107 | 107 | 104 | 63 | 36 |
| JTP077 | 82 | 94 | 104 | 105 | 99 | 56 | 31 |
| JTP188 | 71 | 83 | 86 | 93 | 100 | 75 | 53 |
| JTP196 | 87 | 99 | 103 | 106 | 117 | 90 | 38 |

Example 4

Thermostability of Protease Pfu.

The thermostability of the *Pyrococcus furiosus* protease (Pfu S) purchased from Takara Bio Inc, (Japan) was tested using the same methods as in Example 2. It was found that the thermostability (Relative Activity) was 110% at (80° C./70° C.) and 103% (90° C./70° C.) at pH 4.5.

Example 5. Enzymatic Degradation of Corn Kernel Fiber Using Enzyme Blend Comprising a Polygalacturonase and Pectin Methyl Esterase This example illustrates that pectin-degrading enzymes, for instance a pectinolytic composition comprising a polygalacturonase and pectin methyl esterase, enhances the enzymatic degradation of corn kernel fiber in conjunction with a cellulolytic composition derived from *Trichoderma reesei* and a glucoamylase blend. Industrial whole stillage (Novozymes A/S) was used to simulate a partially de-starched corn kernel fiber. The whole stillage was adjusted to pH 5.0 using 40% v/v sulfuric acid. Kathon CG/ICP II (Sigma-Aldrich, St. Louis, MO) was added to the whole stillage to a final concentration of 0.02% wt/wt. The dry solids content of the whole stillage was measured on a halogen moisture balance (Mettle Toledo, Columbus, OH). Approximately 5 grams of the prepared whole stillage was dispensed into each well of a 24-well polypropylene microplate (Thermo Fisher, Hampton, NH). Water was added to each well to bring the final solids content to 10.0% or 8.5% dry solids.

Each well of the 24-well microplate was treated with 0.6 AGU/g-DS of a commercial glucoamylase blend from Novozymes A/S (Glucoamylase BL), and/or 100 µg/g-DS of a commercial cellulolytic composition from Novozymes A/S (Cellulase 1), and/or a commercial pectinolytic composition from Novozymes A/S (Pectinase 1) dosed at 10, 20, 100, or 400 µg/g-DS. The 24-well microplates were sealed with rubber cap mats and incubated in a humidity-controlled incubator set at 50° C. for 96 hours with constant shaking at 250 RPM on a short-throw orbital shaker table (Infors HT, Basel, Switzerland). After 96 hours each tube was dosed with 5 µl of 40% sulfuric acid, vortexed, and centrifuged for 10 minutes at 3000 g. Samples were then filtered through 0.2 µm filters into HPLC vials for analysis. Measured glucose release from hydrolysis of whole stillage is shown in FIG. 1.

The data in FIG. 1 demonstrates that on both whole stillage samples, the pectinolytic composition had no effect on glucose release from the whole stillage when applied on top of the glucoamylase blend alone, but a synergistic effect is seen when the pectinolytic composition is used on top of the glucoamylase blend in the presence of the cellulolytic composition. This work suggests that the pectinases increase accessibility of the cellulose fiber to cellulolytic degradation, without having any independent activity on cellulose. This is consistent with the scientifically understood mechanisms of pectinases, which would not be expected to exert any direct activity on the cellulose fiber. There was a slight dose response effect on glucose release with a maximum between 20-100 ug-EP/g-ds.

Example 6. Evaluation of Pectinases in SSF

This example illustrates that pectinolytic enzymes, for instance a pectinolytic composition comprising a polygalacturonase and pectin methyl esterase and/or pectin lyase, enhances the ethanol yield during simultaneous saccharification and fermentation in conjunction with a cellulolytic composition derived from *Trichoderma reesei* and a glucoamylase blend.

Simultaneous saccharification and fermentation (SSF) was performed using industrial corn mash liquefied using a commercial alpha-amylase blend from Novozymes A/S (Alpha-amylase Blend 1). An industrial yeast strain yMHCT484 (*S. cerevisiae* expressing a *Gloeophyllum sepiarium* glucoamylase; see WO2018/222990; Novozymes A/S) was cultivated for 18 hours in standard YPD media containing 6% glucose at 32° C. and 120 RPM. After the cultivation the yeast propagation was centrifuged, the supernatant decanted, and the yeast cells resuspended in deionized water. The resuspended cells were enumerated using a NucleoCounter YC-100 (ChemoMetric, Allerod, Denmark). The corn mash was supplemented with 500 ppm of urea and dosed with 0.42 AGU/g-DS of an exogenous commercial glucoamylase blend from Novozymes A/S (Glucoamylase BL2) and/or 100 μg/g-DS of an exogenous commercial cellulolytic composition from Novozymes A/S (Cellulase 1), and/or a pectinolytic composition from Novozymes A/S comprising pectin methyl esterase and endo-polygalacturonase (Pectinase 1) dosed at 50 μg/g-DS, and/or a pectinolytic composition comprising pectin lyase (Pectinase 2) dosed at 50 μg/g-DS. Approximately 50 g of corn mash was dispensed into a 250 mL glass media bottle (Thermo Fisher Scientific, Hampton, NH) for each sample, followed by the addition of approximately 10^8 yeast cells/g of corn mash from the overnight culture. Bottles were incubated at 32° C. on an orbital shaker at 150 RPM for 68 hr. Fermentation was stopped by the addition of 500 μL of 42% sulfuric acid followed by centrifugation at 3000 RPM for 10 minutes. The supernatant was analyzed for ethanol using HPLC-RID. The results of the fermentation with the pectinases is shown in FIG. 2.

Figure 2:
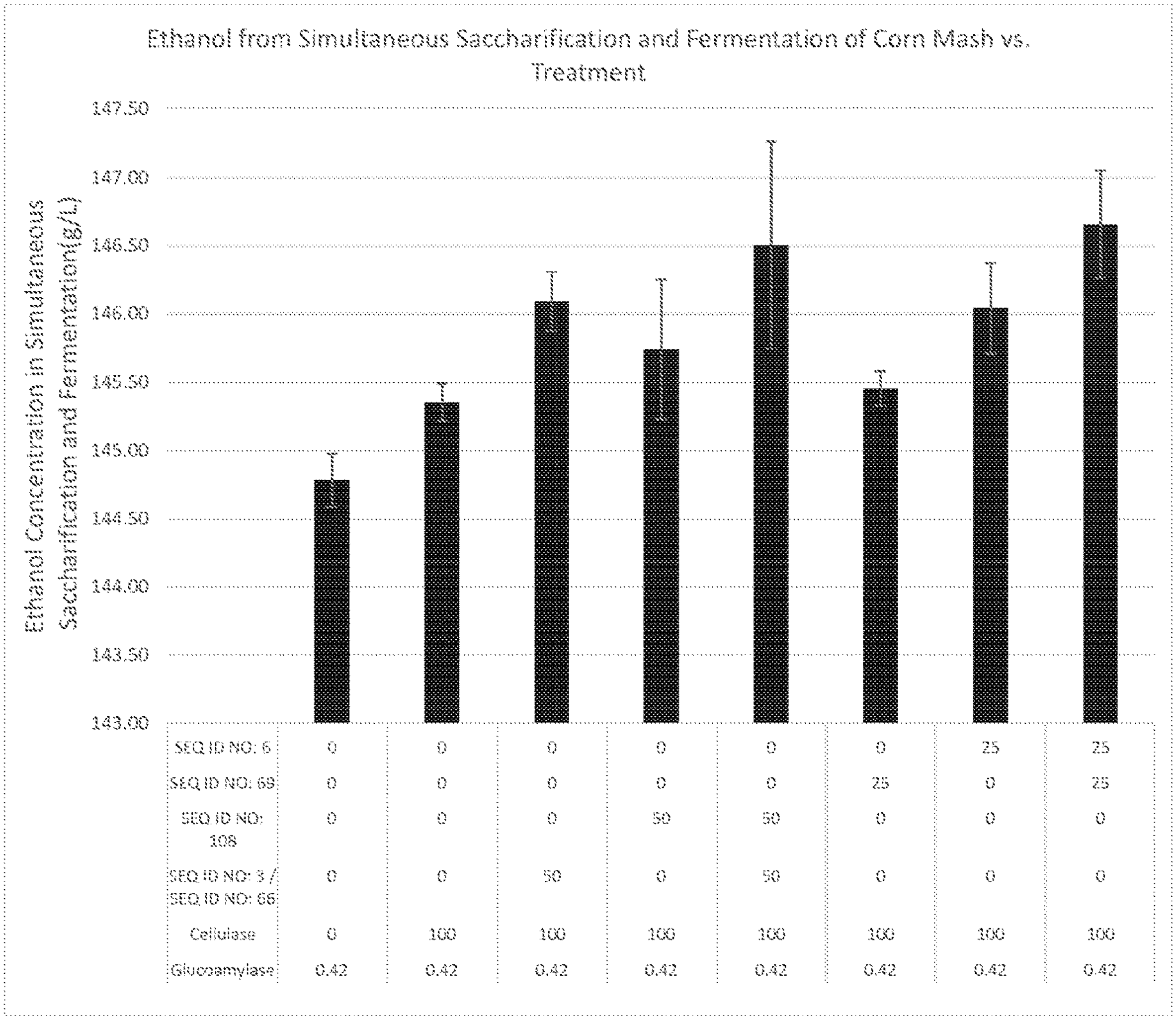
FIG. 2 shows the synergistic effects of multiple pectinolytic activities with a cellulolytic composition during simultaneous saccharification and fermentation of industrial corn mash.

The results shown in FIG. 2 expand upon the findings in Example 1, namely that the pectinase activities tested in this experiment appear to increase cellulose accessibility to a cellulolytic composition. The combination of pectin methyl esterase and polygalacturonase is still synergistically beneficial to the cellulolytic composition, but the findings are expanded in that pectin lyase may also be synergistic with the cellulase independent of other pectinolytic activities. The polygalacturonase is synergistic with the cellulolytic composition even without the pectin methyl esterase, indicating the polygalacturonase is critical to the synergy. Furthermore, when the polygalacturonase and pectin methyl esterase are combined with the cellulolytic composition, the response is improved over the polygalacturonase and cellulolytic composition alone. This is indicative that while the polygalacturonase is synergistic with the cellulolytic composition, the pectin methyl esterase is synergistic with the polygalacturonase, which has an indirect improvement on cellulolytic activity.

Example 7. Construction of Yeast Strains Expressing Heterologous Pectinases

Yeast cells were constructed containing up to two heterologous pectinases under control of a *S. cerevisiae* THD3, TEF2, or PGK1 promoter. Three pieces of DNA containing the promoter, gene, and terminator were designed to allow for homologous recombination between the three DNA fragments and into the X-3 locus of the yeast MEJI-797 (*S. cerevisiae* strain MBG5012 of WO2019/161227 further expressing a *Pycnoporus sanguineus* glucoamylase (SEQ ID NO: 4 of WO2011/066576) and a hybrid *Rhizomucor pusillus* alpha amylase expression cassette (as described in WO2013/006756)) for the single heterologous pectinase insertion. For the constructs with two heterologous pectinase insertions six pieces of DNA containing one set of promoter, gene, and terminator and a separate set of promoter, gene, and terminator were designed to allow for homologous recombination between the six DNA fragments and into the X-3 locus of the yeast MEJI-797.

Synthetic linear uncloned DNA containing 60 bp homology to the X-3 site, *S. cerevisiae* promoter THD3, TEF2, or PGK1 (WO2020/076697) and coding sequence for the *S. cerevisiae* EXG1 or TS signal peptide were synthesized by ThermoFisher Scientific (Waltham, MA). To generate additional linear DNA for transformation into yeast, each of the three linear DNAs containing the left cassette above was PCR amplified.

Synthetic linear uncloned DNA containing the *S. cerevisiae* terminators ENO2 and STE2 and 300 bp homology to the X-3 site was synthesized by Thermo Fisher Scientific.

Synthetic linear uncloned DNA containing coding sequences for the *S. cerevisiae* EXG1 or TS signal peptide, coding sequence for the mature polypeptide and 50 bp ENO2 or STE2 terminators were synthetized by Thermo Fisher Scientific.

The yeast MEJI-797 was transformed with the left, middle, and right integration fragments described above. In each transformation pool a fixed left fragment and right fragment were used as well as a fixed middle fragment containing the pectinase gene with 100 ng of each fragment. To aid homologous recombination of the left, middle, and right fragments at the genomic X-3 sites a plasmid containing Cas9 and guide RNA specific to X-3 (pMcTs442) was also used in the transformation. These four components were transformed into the *S. cerevisiae* strain MEJI-797 following a test electroporation protocol. Transformants were elected on YPD+cloNAT to select for transformants that contain the CRISPR/Cas9 plasmid pMcTs442. Transformants were picked using a Q-Pix Colony Picking System (molecular Devices; San Jose, CA) to inoculate one well of 96-well plate containing YPD+cloNAT media. The plates were grown for 2 days then glycerol was added to 20% final concentration and the plates were stored at −80° C. until needed. Integration of specific pectinase construct was verified by PCR with locus specific primers and subsequent sequencing. The strains generated are shown in Table 9 below.

TABLE 9

| Pectinase Strains | | | | | | |
|---|---|---|---|---|---|---|
| Strain Name | Promoter 1 | SEQ ID NO: (mature polypeptide) | Donor Organism | Promoter 2 | SEQ ID NO: (mature polypeptide) | Donor Organism |
| S1074-F01 | THD3 | SEQ NO. 4 | *Aspergillus aculeatus* | TEF2 | SEQ NO. 67 | *Aspergillus aculeatus* |
| S1074-A03 | THD3 | SEQ NO. 1 | *Aspergillus niger* | TEF2 | SEQ NO. 64 | *Aspergillus niger* |
| S1030-A03 | THD3 | SEQ NO. 4 | *Aspergillus aculeatus* | | | |
| S1030-A04 | THD3 | P65U | *Aspergillus niger* | | | |
| S1030-A05 | THD3 | SEQ NO. 52 | *Talaromyces calidicanius* | | | |
| S1030-A06 | THD3 | SEQ NO. 55 | *Penicillium* sp. XZ2495 | | | |
| S1030-A07 | THD3 | SEQ NO. 58 | *Penicillium* sp-54788 | | | |
| S1030-A08 | THD3 | SEQ NO. 52 | *Talaromyces calidicanius* | PGK1 | SEQ NO. 82 | *Aspergillus aculeatus* |
| S1030-F09 | THD3 | SEQ NO. 55 | *Penicillium* sp. XZ2495 | PGK1 | SEQ NO. 82 | *Aspergillus aculeatus* |
| S1030-A10 | THD3 | SEQ NO. 58 | *Penicillium* sp-54788 | PGK1 | SEQ NO. 82 | *Aspergillus aculeatus* |
| S1030-B11 | THD3 | SEQ NO. 52 | *Talaromyces calidicanius* | PGK1 | SEQ NO. 85 | *Aspergillus aculeatus* |
| S1030-A12 | THD3 | SEQ NO. 55 | *Penicillium* sp. XZ2495 | PGK1 | SEQ NO. 85 | *Aspergillus aculeatus* |
| S1031-A01 | THD3 | SEQ NO. 58 | *Penicillium* sp-54788 | PGK1 | SEQ NO. 85 | *Aspergillus aculeatus* |

Example 8. Evaluation of Pectinase Expressing Yeast in SSF

Figure 3:
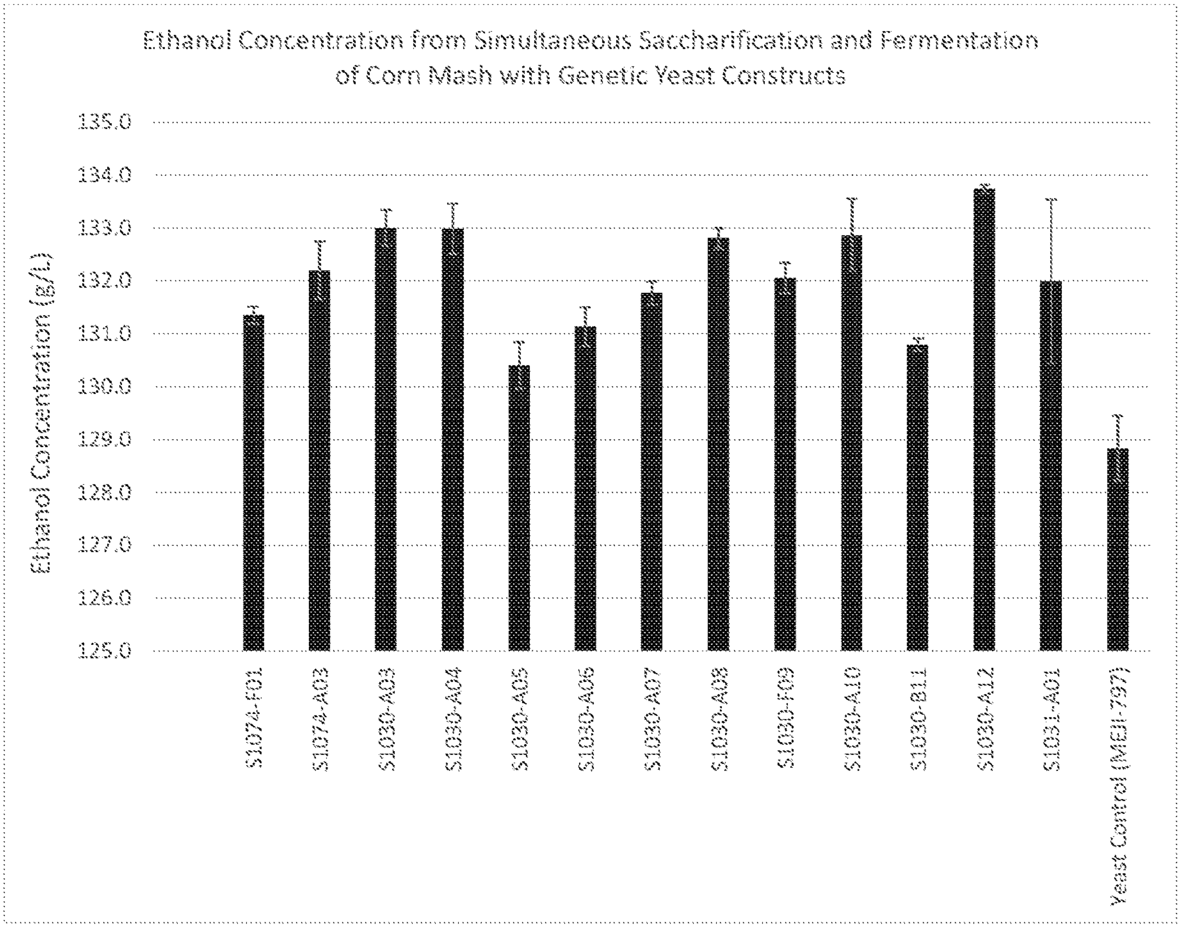
FIG. 3 shows ethanol yield from yeast constructs with heterologous expression of pectinolytic enzymes in simultaneous saccharification and fermentation.

Simultaneous saccharification and fermentation (SSF) with the pectinase expressing yeast strains described in Example 7 was performed using industrial corn mash liquified using Alpha-amylase Blend 2 (Novozymes A/S). The yeast strain constructs expressing heterologous pectinases were cultivated for 18 hours in standard YPD media containing 6% glucose at 32° C. and 120 RPM. After the cultivation, samples were centrifuged, the supernatant decanted, and the yeast cells resuspended in deionized water. The resuspended cells were enumerated using a NucleoCounter YC-100 (ChemoMetric, Allerod, Denmark). The corn mash was supplemented with 500 ppm of urea and dosed with 0.42 AGU/g-DS of exogenous Glucoamylase SA (GSA) (Novozymes A/S) and 100 μg/g-DS of exogenous cellulolytic composition A product (CCA; Novozymes A/S). Approximately 50 g of corn mash was dispensed into a 250 mL glass media bottle (Thermo Fisher Scientific, Hampton, NH) for each sample, followed by the addition of approximately 10^8 yeast cells/g of corn mash from the overnight culture. Bottles were incubated at 32° C. on an orbital shaker at 120 RPM for 65 hr. Fermentation was stopped by the addition of 500 μL of 42% sulfuric acid followed by centrifugation at 3000 RPM for 10 minutes. The supernatant was analyzed for ethanol using HPLC-RID. The fermentation results of the yeast strains expressing pectinases is shown in FIG. 3. As shown in FIG. 3, all of the pectinase expressing yeast strains outperformed the control yeast in terms of ethanol yield at the time point sampled. It is noted that the data shown in FIG. 3 corroborate the results demonstrated in Example 1 and Example 2, namely the top performing yeast in this example was the yeast expressing both the polygalacturonase and the pectin methyl esterase that were exogenously used in those examples to show a synergistic effect under the conditions tested.

Example 9. Evaluation of Pectinases on Degradation of Corn Kernel Fiber

This example illustrates that pectin-degrading enzymes, for instance an enzyme blend comprising a polygalacturonase and pectin methyl esterase, enhances the enzymatic degradation of corn kernel fiber in conjunction with a cellulolytic composition derived from *Trichoderma reesei* and a glucoamylase. Industrial dry grind corn flour (Novozymes A/S) was de-starched and washed to simulate corn kernel fiber that would be present in the simultaneous saccharification and fermentation process step of a corn to ethanol bioprocess. Coin flour was slurried with water to a dry solids content of 32.0% DS and adjusted to pH 5.0 using a 5% v/v solution of sulfuric acid. The corn flour slurry was split into two samples to which either Alpha-Amylase 369 (AA369; Novozymes A/S)) or Alpha-amylase blend 2 (Novozymes A/S) were added at a dose of 0.06% wt/g-DS. The mixtures were transferred into stainless steel beakers and incubated in a LABOMAT (Mathis A S, Oberhasil, Switzerland) at 85° C. for 120 minutes with rotary tumble mixing with a period of 90 seconds. After incubation the liquefied corn mash was washed with deionized water, recovering the corn mash solids. The corn mash solids were slurried with water to a dry solids content of 25.0% DS and adjusted to pH 5.0 using a 5% v/v solution of sulfuric acid. To the corn mash slurry a glucoamylase blend (GSA; Novozymes A/S) was added at a dose of 60 AGU/g-DS to hydrolyze the remaining starch and placed in a short throw orbital incubating shaker (Infors HT, Basel, Switzerland) at 32° C. for 60 hours. After incubation, the slurries were centrifuged at 3,000 RPM for 15 minutes and the supernatant discarded. Water was added to the decanted solids to wash any soluble sugars from the de-starched corn kernel fiber solids. The washed solids were again centrifuged at 3,000 RPM for 15 minutes and the supernatant discarded.

The dry solids content of the washed de-starched corn kernel fiber solids was measured on a halogen moisture balance (Mettle Toledo, Columbus, OH). Penicillin (Sigma-Aldrich, St. Louis, MO) was added to the de-starched corn kernel fiber at a final concentration of 3 parts per million. Approximately 5 grams of the prepared de-starched corn kernel fiber was dispensed into each well of a 24-well polypropylene microplate (Thermo Fisher, Hampton, NH). Ethanol (Sigma-Aldrich, St. Louis, MO) was added to the de-starched corn kernel fiber at a final concentration of 12% wt./vol in the slurry. Water was added to each well to bring the final solids content to 5.0% dry solids.

Figure 4:
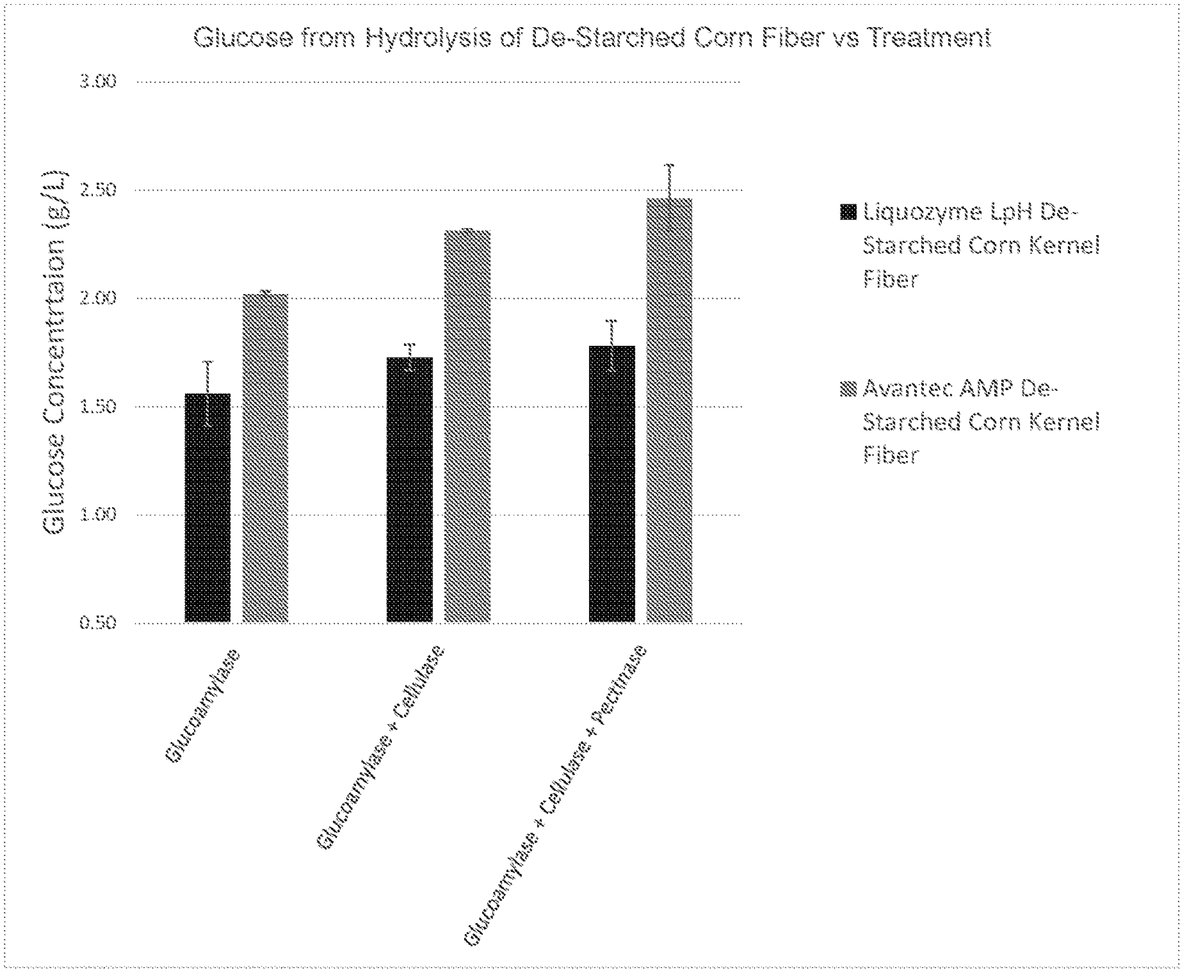
FIG. 4 shows the synergistic effect of a pectinolytic enzyme with a cellulolytic composition on hydrolysis of de-starched corn kernel fiber.

Each well of the 24-well microplate was treated with 0.6 AGU/g-DS of a glucoamylase blend (GSA; Novozymes A/S), and/or 100 μg/g-DS of a cellulolytic composition (Cellulase 2; Novozymes A/S), and/or a pectinase enzyme preparation comprising a pectin methyl esterase and a endo-polygalacturonase (Pectinase 1) dosed at 50 μg/g-DS. The 24-well microplates were sealed with rubber cap mats and incubated in a humidity-controlled incubator set at 50° C. for 96 hours with constant shaking at 250 RPM on a short-throw orbital shaker table (Infors HT, Basel, Switzerland). After 96 hours each tube was dosed with 5 μl of 40% sulfuric acid, vortexed, and centrifuged for 10 minutes at 3000 g. Samples were then filtered through 0.2 μm filters into HPLC vials for analysis. Measured glucose release from hydrolysis of whole stillage is shown in FIG. 4.

Example 10. Evaluation of Hydrolysis Using Pectinases

Distiller's Dried Grains with Solubles (DDGS) was hydrolysed by enzymes 10% dry solid (DS) at pH4.5, 32 C for 48 h. The total weight of each reaction is 2 g. The control consists of GH30+ Cellulase 1 (1:1) of 60 ug EP/g DS. Certain polypeptides having pectinase activity were evaluated for their ability to release glucose compared to the control.

Figure 5:
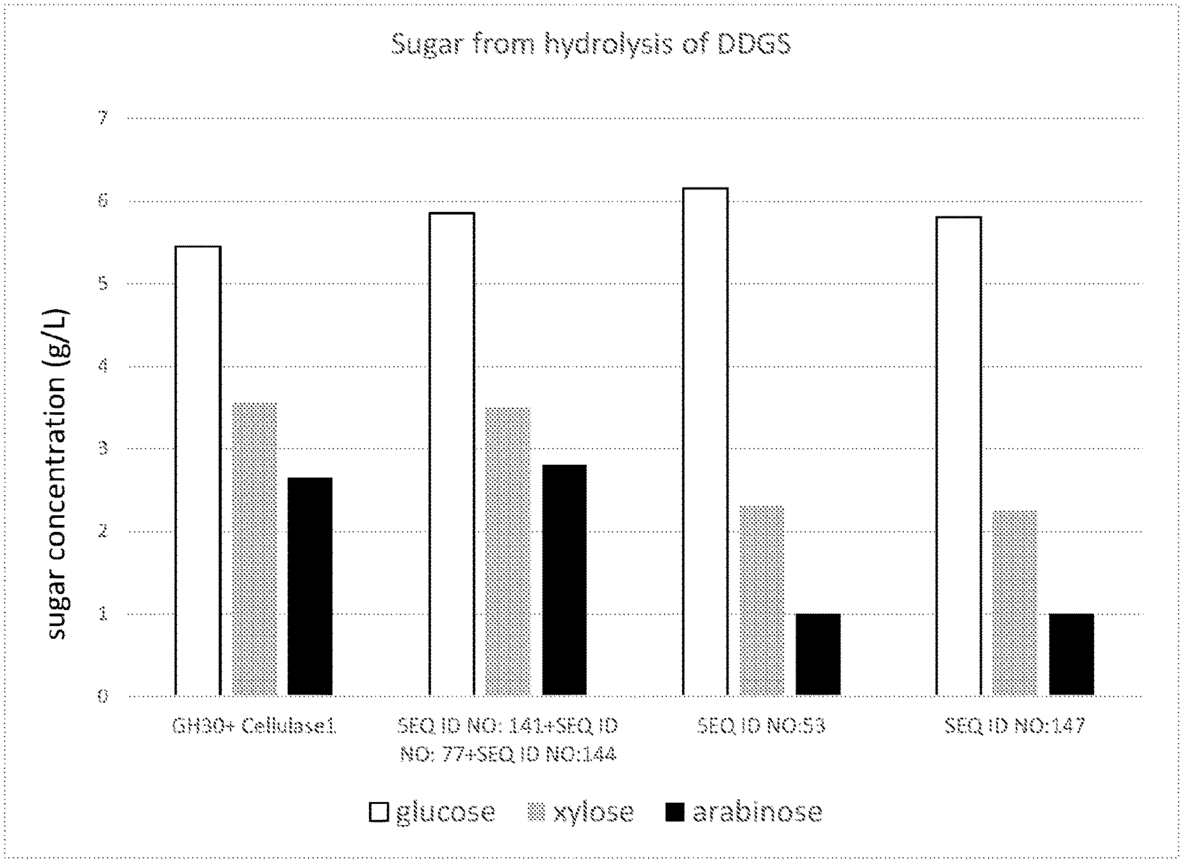
FIG. 5 shows the effect of pectinolytic enzyme alone on hydrolysis of DDGS.

A pectinolytic composition comprising SEQ ID NO: 141, SEQ ID NO: 77, and SEQ ID NO: 144 (Pectinase 3), and the polypeptides having pectinase activity of SEQ ID NO: 53 and SEQ ID NO: 147 were loaded at 60 ug EP/g DS. After hydrolysis, supernatants from 10 minutes centrifugation at 10000 rmp were treated by 9% H2SO4 at 90 C for 40 min, then the supernatants were filtered and run HPLC (87H column) for sugar analysis. The hydrolysis results shown in FIG. 5 showed that Pectinase 3 and the polypeptides of SEQ ID NO: 53 and SEQ ID NO: 147 alone can release more glucose than control.

Example 11. Cloning and Expression of CE12 and PL4_5 Pectinases from *Aspergillus aculeatus*

Genes encoding a putative CE12 family pectin acetylesterase and a putative PL4_5 family rhamnogalacturonan lyase from were cloned from an isolate of *Aspergillus aculeatus* and recombinantly expressed in *Aspergillus oryzae*. The sequence identities for the genes cloned and their corresponding amino acid sequences are listed in Table 10 below. The strain of *Aspergillus aculeatus* used was isolated on or prior to 1943 and is available from CBS-KNAW Fungal Biodiversity Centre, Utrecht, The Netherlands, as CBS 101.43. The country of origin has not been reported for this isolate.

TABLE 10

| Strain | CAZy family | Nucleotide sequence | Full-length polypeptide sequence | Mature polypeptide sequence |
|---|---|---|---|---|
| *Aspergillus aculeatus* | CE12 | SEQ ID NO: 82 | SEQ ID NO: 83 | SEQ ID NO: 84 |
| *Aspergillus aculeatus* | PL4_5 | SEQ ID NO: 136 | SEQ ID NO: 137 | SEQ ID NO: 138 |

Chromosomal DNA was isolated from *Aspergillus aculeatus* and used for whole genome sequencing by standard methods known to the person skilled in the art. The whole genome sequence was assembled with the IDBA genome assembler (Peng, Y., et al. Bioinformatics. (2012), 28: 1420-1428), and genes were annotated on the genome with the GeneMark 2.3c gene prediction software (Ter-Hovhannisyan V. et al. Genome Res. (2008) 18(12):1979-90). The set of peptide sequences predicted from the annotated genes was searched for similarity to the CE12 and PL4_5 peptide domains as defined by CAZY, the Carbohydrate Active eZYme database (available on the world wild web at cazy-.org, Lombard V, et al. (2014) Nucleic Acids Res 42:D490-D495) and full-length polypeptides with SEQ ID NO: 83 and SEQ ID NO: 137 were found (the mature polypeptides of which are SEQ ID NO: 84 and SEQ ID NO: 138, respectively).

The corresponding DNA sequences, with SEQ ID NO: 82 and SEQ ID NO: 136, were PCR amplified from genomic DNA isolated from *Aspergillus aculeatus* with gene-specific primers that also append a Kozak translation initiation sequence "TCACC" immediately 5' of the start codon, and cloned into the *Aspergillus* expression vector pMStr57 (WO 04/032648) that had been digested with BamHI and XhoI. The cloned genes were sequenced and confirmed to be identical to the corresponding genome sequences and transformed into the *Aspergillus oryzae* strain MT3568 (WO 11/057140; incorporated herein by reference in its entirety) by the methods described in Christensen et al., 1988, Biotechnology 6, 1419-1422 and WO 04/032648; (incorporated herein by reference in its entirety). Transformants were selected during regeneration from protoplasts based on the ability, conferred by a selectable marker in the expression vector, to utilize acetamide as a nitrogen source, and were subsequently re-isolated under selection.

Production of the recombinant peptides was evaluated by culturing transformants in 96-well deep-well microtiter plates for 4 days at 30° C. in 0.75 ml of YPG medium (WO 05/066338; incorporated herein by reference in its entirety) for transformants with the CE12 encoding gene or in 0.25 ml of YPG medium and DAP-4C-1 medium (WO 12/103350) for transformants with the PL4_5 encoding gene. Recombinant expression was monitoring by SDS-PAGE. A single *Aspergillus* transformant was selected for each gene based on expression yield as evaluated in microtiter plate fermentation.

Chromatographic Purification of CE12 and PL4_5 Peptides from *Aspergillus aculeatus*

For large-scale production of the recombinant enzymes, and the *Aspergillus* transformants were cultured in 500 ml baffled flasks containing 150 ml of DAP-4C-1 medium. The cultures were shaken on a rotary table at 150 RPM at a temperature of 30° C. for 4 days. Culture broth was separated from cellular material by passage through a 0.22 um filtration unit. The pH of filtered fermentation broth was adjusted to around pH 7.5 and 1.8M ammonium sulfate was added. The sample was subsequently applied to a 5 ml HiTrap™ Phenyl (HS) column on an Äkta Explorer. Prior to loading, the column had been equilibrated in 5 column volumes (CV) of 50 mM HEPES+1.8M AMS pH 7. To remove unbound material, the column was washed with 5 CV of 50 mM HEPES+1.8M AMS pH 7. The target protein was eluted from the column into a 10 ml loop using 50 mM HEPES+20% isopropanol pH 7. From the loop, the sample was loaded onto a desalting column (HiPrep™ 26/10 Desalting), which had been equilibrated with 3 CV of 50 mM HEPES+100 mM NaCl pH 7.0. The target protein was eluted with 50 mM HEPES+100 mM NaCl pH 7.0 and relevant fractions were selected and pooled based on the chromatogram. The flow rate was 5 ml/min.

Protein concentration in the final sample was estimated by measuring absorption at 280 nm.

Example 12. Preparation of Media for Examples 13-18

The Media used in Examples 13-18 was prepared as follows.

All the related media or reagents were sterilized by autoclaving at 121° C. for 20 mins with otherwise specially mentioned.

LB plates were composed of 10 g of Bacto-tryptone, 5 g of yeast extract, 5 g of sodium chloride, 15 g of agar, and deionized water to 1 liter.

LB medium was composed of 10 g of Bacto-tryptone, 5 g of yeast extract, and 5 g of sodium chloride, and deionized water to 1 liter.

LB+Ampicillin medium was prepared by adding 100 mg/ml Ampicillin to sterilized LB medium or LB plate at 1:1000 when medium cooling to <60° C.

PDA plates were composed of 39 grams of potato dextrose agar and deionized water to 1 liter.

¼ PDA plates were composed of 9.75 grams of potato dextrose agar, 11.25 grams of agar and deionized water to 1 liter.

Selective medium for MT3568 were composed of 342 g of sucrose, 20 g of agar powder, 20 ml of COVE salt solution, and deionized water to 1 liter. The medium was sterilized by autoclaving at 121° C. for 20 minutes. The medium was cooled to 60° C. and 10 ml of 1M acetamide (filter sterilized) was added.

COVE salt solution was composed of 26 g of $MgSO_4{\cdot}7H_2O$, 26 g of KCL, 76 g of $KH_2PO_4$, 50 ml of COVE trace metal solution, and deionized water up to 1 liter.

COVE trace metal solution was composed of 0.04 g of $Na_2B_4O_7{\cdot}10H_2O$, 0.4 g of $CuSO_4{\cdot}5H_2O$, 0.8 g of $FeSO_4{\cdot}7H_2O$, 0.8 g of $MnSO_4{\cdot}H_2O$, 0.8 g of $Na_2MoO_4{\cdot}2H_2O$, 8 g of $ZnSO_4{\cdot}7H_2O$, and deionized water up to 1 liter.

TOP agar was composed of 6 g SeaKem GTG agarose, 20 ml of COVE salt solution, 342 g sucrose in a final volume of 1 L with ddH2O. After autoclaving, add 10 ml of 1M Acetamide for the transformation selection of MT3568.

COVE reisolation medium was composed of 30 g of sucrose, 20 ml of COVE salt solution, 20 g of agar, and deionized water up to 1 liter. Autoclave at 121° C. for 20 mins. After cooling to 60° C., the medium was supplemented with 10 ml of Triton X-100, and 10 mM acetamide for MT3568.

COVE slant medium was composed of 30 g of sucrose, 20 ml of COVE salt solution, 20 g of agar, and deionized water up to 1 liter. Autoclave at 121° C. for 20 mins. After cooling to 60 C, the medium was supplemented with 10 mM acetamide for MT3568.

DAP4C-1 medium was composed of 0.5 g yeast extract, 10 g maltose, 20 g glucose, 11 g $MgSO_4{\cdot}7H_2O$, 1 g $KH_2PO_4$, 2.2 g Citric acid•$H_2O$, 5.2 g $K_3PO_4{\cdot}H_2O$, supplemented with 0.5 ml of AMG Trace element solution, and deionized water up to 1 liter. Stir to resolve. Aliquot 400 ml to a shake flask of 2 L. Add 1 tablet of 0.5 g calcium carbonate to each flask. After autoclave at 121° C. for 20 mins, 3.3 ml of 20% lactic acid and 9.3 ml of 50% $(NH_4)_2HPO_4$, both sterile, were added to each flask.

AMG Trace element solution was composed of 6.8 g $ZnCl_2$, 2.5 g $CuSO_4{\cdot}5H_2O$, 0.24 g $NiCl_2{\cdot}5H_2O$, 13.9 g $FeSO_4{\cdot}7H2O$, 13.6 g $MnSO_4{\cdot}5H_2O$, 3 g Citric acid·$H_2O$, and deionised water to 1000 ml.

Example 13. Characterization of GH28 Family Rhamnogalacturonase from *Talaromyces calidicanius*

This example describes the characterization of a GH28 family rhamnogalacturonase from *Talaromyces calidicanius*, the full-length sequence of which is disclosed as SEQ ID NO: 53 and the mature polypeptide of which is disclosed as SEQ ID NO: 54.

Strains

*Escherichia coli* Top10 strain, purchased from TIANGEN (TIANGEN Biotech Co. Ltd., Beijing, China), was used to propagate our expression constructs.

*Aspergillus oryzae* MT3568, described in WO2014026630A1, which is incorporated herein by reference for its teachings pertaining to Example 2 therein, is an amdS (acetamidase) disrupted derivative of *A. oryzae* JaL355 (WO02/40694; incorporated herein by reference) in which pyrG auxotrophy was restored by disrupting the *A. oryzae* acetamidase (amdS) gene with the pyrG gene.

The fungal strain NN058141 was isolated from soil samples collected from Guizhou Province, China, in 2014 by the dilution plate method with PDA medium pH3, 25° C. It was then purified by transferring a single conidium onto a PDA agar plate. The strain NN058141 was identified as *Talaromyces calidicanius*, based on both morphological characteristics and ITS rDNA sequence.

Genomic DNA Extraction

The *Talaromyces calidicanius* strain NN058141 was inoculated onto a PDA plate and incubated for 7 days at 25° C. in the darkness. Several mycelia-PDA plugs were inoculated into 500 ml shake flasks containing 100 ml of YPG medium. The flasks were incubated for 2 days at 25° C. with shaking at 160 rpm. The mycelia were collected by filtration through MIRACLOTH® (Calbiochem, La Jolla, CA, USA) and frozen under liquid nitrogen. Frozen mycelia were ground, by a mortar and a pestle, to a fine powder, and genomic DNA was isolated using DNEASY® Plant Maxi Kit (24) (QIAGEN GmbH, Hilden, Germany) following the manufacturer's instruction.

Genome Sequencing, Assembly and Annotation

The extracted genomic DNA samples of NN058141 were delivered to Exiqon A/S (Denmark) for genome sequencing using an ILLUMINA® MISEQ® System (Illumina, Inc., San Diego, CA, USA). The raw reads were assembled at Novozymes Denmark using program Spades (Anton Bankevich et al., 2012, *Journal of Computational Biology*, 19(5): 455-477). The assembled sequences were analyzed using standard bioinformatics methods for gene identification and function prediction. GeneMark-ES fungal version (Ter-Hovhannisyan V et al., 2008, *Genome Research* 18(12): 1979-1990) was used for gene prediction. Blastall version 2.2.10 (Altschul et al., 1990, *Journal of Molecular Biology*, 215(3): 403-410, ftp://ftp.ncbi.nlm.nih.gov/blast/executables/release/2.2.10/) and HMMER version 2.1.1 (National Center for Biotechnology Information (NCBI), Bethesda, MD, USA) were used to predict function based on structural homology. The GH28 family rhamnogalacturonase from *Talaromyces calidicanius* was identified directly by analysis of the Blast results. The Agene program (Munch and Krogh, 2006, *BMC Bioinformatics*, 7:263) and SignalP program (Nielsen et al., 1997, *Protein Engineering*, 10: 1-6) were used to identify start codons. SignalP program was further used to predict signal peptides. Pepstats (Rice et al., 2000, *Trends Genet,* 16(6): 276-277) was used to predict isoelectric points and molecular weights.

Example 14. Characterization of a GH28 Family Rhamnogalacturonase from *Penicillium* sp. XZ2495

This example describes the characterization of a GH28 family rhamnogalacturonase from *Penicillium* sp. XZ2495, the full-length sequence of which is disclosed as SEQ ID NO: 56 and the mature polypeptide of which is disclosed as SEQ ID NO: 57.

Strains

*Escherichia coli* Top10 strain, purchased from TIANGEN (TIANGEN Biotech Co. Ltd., Beijing, China), was used to propagate our expression constructs.

*Aspergillus oryzae* MT3568 is an amdS (acetamidase) disrupted derivative of *A. oryzae* JaL355 in which pyrG auxotrophy was restored by disrupting the *A. oryzae* acetamidase (amdS) gene with the pyrG gene.

The fungal strain NN058240 was isolated from soil samples collected from Guizhou Province, China, in 2014 by the dilution plate method with PDA medium pH3, 25° C. It was then purified by transferring a single conidium onto a PDA agar plate. The strain NN058240 was identified as *Penicillium* sp. XZ2495, based on both morphological characteristics and ITS rDNA sequence.

Genome Sequencing, Assembly and Annotation

The extracted genomic DNA samples of NN058240 were delivered to Exiqon A/S (Denmark) for genome sequencing using an ILLUMINA® MISEQ® System (Illumina, Inc., San Diego, CA, USA). The raw reads were assembled at Novozymes Denmark using program Spades (Anton Bankevich et al., 2012, *Journal of Computational Biology,* 19(5): 455-477). The assembled sequences were analyzed using standard bioinformatics methods for gene identification and function prediction. GeneMark-ES fungal version (Ter-Hovhannisyan V et al., 2008, *Genome Research* 18(12): 1979-1990) was used for gene prediction. Blastall version 2.2.10 (Altschul et al., 1990, *Journal of Molecular Biology,* 215(3): 403-410, ftp://ftp.ncbi.nlm.nih.gov/blast/executables/release/2.2.10/) and HMMER version 2.1.1 (National Center for Biotechnology Information (NCBI), Bethesda, MD, USA) were used to predict function based on structural homology. The GH28 family rhamnogalacturonase from *Penicillium* sp. XZ2495 was identified directly by analysis of the Blast results. The Agene program (Munch and Krogh, 2006, *BMC Bioinformatics,* 7:263) and SignalP program (Nielsen et al., 1997, *Protein Engineering,* 10: 1-6) were used to identify start codons. SignalP program was further used to predict signal peptides. Pepstats (Rice et al., 2000, *Trends Genet,* 16(6): 276-277) was used to predict isoelectric points and molecular weights.

Genomic DNA Extraction

The *Penicillium* sp. XZ2495 strain NN058240 was inoculated onto a PDA plate and incubated for 7 days at 25° C. in the darkness. Several mycelia-PDA plugs were inoculated into 500 ml shake flasks containing 100 ml of YPG medium. The flasks were incubated for 2 days at 25° C. with shaking at 160 rpm. The mycelia were collected by filtration through MIRACLOTH® (Calbiochem, La Jolla, CA, USA) and frozen under liquid nitrogen. Frozen mycelia were ground, by a mortar and a pestle, to a fine powder, and genomic DNA was isolated using DNEASY® Plant Maxi Kit (24) (QIAGEN GmbH, Hilden, Germany) following the manufacturer's instruction.

Example 15. Characterization of a GH28 Family Rhamnogalacturonase from *Penicillium* sp-54788

This example describes the characterization of a GH28 family rhamnogalacturonase from *Penicillium* sp-54788, the full-length sequence of which is disclosed as SEQ ID NO: 59 and the mature polypeptide of which is disclosed as SEQ ID NO: 60.

Strains

*Escherichia coli* Top10 strain, purchased from TIANGEN (TIANGEN Biotech Co. Ltd., Beijing, China), was used to propagate our expression constructs.

*Aspergillus oryzae* MT3568 is an amdS (acetamidase) disrupted derivative of *A. oryzae* JaL355 in which pyrG auxotrophy was restored by disrupting the *A. oryzae* acetamidase (amdS) gene with the pyrG gene.

The fungal strain NN054788 was isolated from soil samples collected from Tibet, China, in 2012 by the dilution plate method with PDA medium, pH7, 4° C. It was then purified by transferring a single conidium onto a % PDA agar plate. The strain NN054788 was identified as *Penicillium* sp-54788 based on both morphological characteristics and ITS rDNA sequence.

Genomic DNA Extraction

The *Penicillium* sp-54788 strain NN054788 was inoculated onto a PDA plate and incubated for several days at 25° C. in the darkness. The mycelia were collected by scraping from agar plate with the sterilized scalpel and transferred to Lysing Matrix A tube (MP Biomedicals GmbH, Eschwege, Germany) and frozen under liquid nitrogen. Frozen mycelia were ground by MiniG1600 (SPEX SamplePrep LLC, New Jersey, United States), to a fine powder, and genomic DNA was isolated using DNEASY® Plant Mini Kit (QIAGEN GmbH, Hilden, Germany) following the manufacturer's instruction.

Genome Sequencing, Assembly and Annotation

The extracted genomic DNA samples of NN054788 were delivered to Novozymes Davis (USA) for genome sequencing using an ILLUMINA® MISEQ® System (Illumina, Inc., San Diego, CA, USA). The raw reads were assembled at Novozymes Denmark using program Spades (Anton Bankevich et al., 2012, *Journal of Computational Biology,* 19(5): 455-477). The assembled sequences were analyzed using standard bioinformatics methods for gene identification and function prediction. GeneMark-ES fungal version (Ter-Hovhannisyan V et al., 2008, *Genome Research* 18(12): 1979-1990) was used for gene prediction. Blastall version 2.2.10 (Altschul et al., 1990, *Journal of Molecular Biology,* 215(3): 403-410, ftp://ftp.ncbi.nlm.nih.gov/blast/executables/release/2.2.10/) and HMMER version 2.1.1 (National Center for Biotechnology Information (NCBI), Bethesda, MD, USA) were used to predict function based on structural homology. The GH28 family rhamnogalacturonase from *Penicillium* sp-54788 was identified directly by analysis of the Blast results. The Agene program (Munch and Krogh, 2006, *BMC Bioinformatics,* 7:263) and SignalP program (Nielsen et al., 1997, *Protein Engineering,* 10: 1-6) were used to identify start codons. SignalP program was further used to predict signal peptides. Pepstats (Rice et al., 2000, *Trends Genet,* 16(6): 276-277) was used to predict isoelectric points and molecular weights.

Example 16. Characterization of a PL4_1 Rhamnogalacturonan Lyase from *Sporormia fimetaria*

This example describes the characterization of a PL4_1 family rhamnogalacturonan lyase from *Sporormia fimetaria*, the full-length sequence of which is disclosed as SEQ ID NO: 140 and the mature polypeptide of which is disclosed as SEQ ID NO: 141.

Strains

*Escherichia coli* Top10 strain, purchased from TIANGEN (TIANGEN Biotech Co. Ltd., Beijing, China), was used to propagate our expression constructs.

*Aspergillus oryzae* MT3568 is an amdS (acetamidase) disrupted derivative of *A. oryzae* JaL355 in which pyrG auxotrophy was restored by disrupting the *A. oryzae* acetamidase (amdS) gene with the pyrG gene.

The fungal strain NN047801 was isolated from litter samples collected from China, in 1998 by the dilution plate method with PDA medium pH7, 25° C. It was then purified by transferring a single conidium onto a PDA agar plate. The strain NN047801 was identified as *Sporormia fimetaria*, based on both morphological characteristics and ITS rDNA sequence.

Genomic DNA Extraction

The *Sporormia fimetaria* strain NN047801 was inoculated onto a PDA plate and incubated for 7 days at 28° C. in the darkness. Several mycelia-PDA plugs were inoculated into 500 ml shake flasks containing 100 ml of YPG medium. The flasks were incubated for 3 days at 28° C. with shaking at 160 rpm. The mycelia were collected by filtration through MIRACLOTH® (Calbiochem, La Jolla, CA, USA) and frozen under liquid nitrogen. Frozen mycelia were ground, by a mortar and a pestle, to a fine powder, and genomic DNA was isolated using DNEASY® Plant Maxi Kit (24) (QIAGEN GmbH, Hilden, Germany) following the manufacturer's instruction.

Genome Sequencing, Assembly and Annotation

The extracted genomic DNA samples of NN047801 underwent genome sequencing. The assembled sequences were analyzed using standard bioinformatics methods for gene identification and functional prediction. GeneMark-ES fungal version (Ter-Hovhannisyan V et al., 2008, *Genome Research,* 18(12): 1979-1990) was used for gene prediction. Blastall version 2.2.10 (Altschul et al., 1990, *Journal of Molecular Biology,* 215(3): 403-410, ftp://ftp.ncbi.nlm.nih.gov/blast/executables/release/2.2.10/) and HMMER version 2.1.1 (National Center for Biotechnology Information (NCBI), Bethesda, MD, USA) were used to predict function based on structural homology. The PL4_1 family rhamnogalacturonan lyase from *Sporormia fimetaria* was identified directly by analysis of the Blast results. The Agene program (Munch and Krogh, 2006, *BMC Bioinformatics,* 7:263) and SignalP program (Nielsen et al., 1997, *Protein Engineering,* 10: 1-6) were used to identify start codons. SignalP program was further used to predict signal peptides. Pepstats (Rice et al., 2000, *Trends Genet,* 16(6): 276-277) was used to predict isoelectric points and molecular weights.

Example 17. Characterization of a GH28 Family Polygalacturonase from *Penicillium oxalicum*

This example describes the characterization of a GH28 family polygalacturonase from *Penicillium oxalicum*, the full-length sequence of which is disclosed as SEQ ID NO: 143 and the mature polypeptide of which is disclosed as SEQ ID NO: 144.

Strains

*Escherichia coli* Top10 strain, purchased from TIANGEN (TIANGEN Biotech Co. Ltd., Beijing, China), was used to propagate our expression constructs.

*Aspergillus oryzae* MT3568 is an amdS (acetamidase) disrupted derivative of *A. oryzae* JaL355 in which pyrG auxotrophy was restored by disrupting the *A. oryzae* acetamidase (amdS) gene with the pyrG gene.

The fungal strain NN051380 was isolated from a soil sample collected from China, by dilution on PDA plates at 25° C. and then purified by transferring a single conidium onto a PDA plate. The NN051380 strain was identified as *Penicillium oxalicum*, based on both morphological characteristics and ITS rDNA sequence.

Genomic DNA Extraction

The *Penicillium oxalicum* strain NN051380 was inoculated onto a PDA plate and incubated for 7 days at 30° C. in the darkness. Several mycelia-PDA plugs were inoculated into 500 ml shake flasks containing 100 ml of YPG medium. The flasks were incubated for 3 days at 30° C. with shaking at 160 rpm.

The mycelia were collected by filtration through MIRACLOTH® (Calbiochem, La Jolla, CA, USA) and frozen under liquid nitrogen. Frozen mycelia were ground, by a mortar and a pestle, to a fine powder, and genomic DNA was isolated using DNEASY® Plant Maxi Kit (24) (QIAGEN GmbH, Hilden, Germany) following the manufacturer's instruction.

Genome Sequencing, Assembly and Annotation

The extracted genomic DNA samples of NN051380 underwent genome sequencing. The assembled sequences were analyzed using standard bioinformatics methods for gene identification and functional prediction. GeneMark-ES fungal version (Ter-Hovhannisyan V et al., 2008, *Genome Research,* 18(12): 1979-1990) was used for gene prediction. Blastall version 2.2.10 (Altschul et al., 1990, *Journal of Molecular Biology,* 215(3): 403-410, ftp://ftp.ncbi.nlm.nih.gov/blast/executables/release/2.2.10/) and HMMER version 2.1.1 (National Center for Biotechnology Information (NCBI), Bethesda, MD, USA) were used to predict function based on structural homology. The GH28 family polygalacturonase from *Penicillium oxalicum* was identified directly by analysis of the Blast results. The Agene program (Munch and Krogh, 2006, *BMC Bioinformatics,* 7:263) and SignalP program (Nielsen et al., 1997, *Protein Engineering,* 10: 1-6) were used to identify start codons. SignalP program was further used to predict signal peptides. Pepstats (Rice et al., 2000, *Trends Genet,* 16(6): 276-277) was used to predict isoelectric points and molecular weights.

Example 18. Characterization of a GH28 Family Rhamnogalacturonase from *Talaromyces* sp. XZ2925

This example describes the characterization of a GH28 family rhamnogalacturonase from *Talaromyces* sp. ZX2925, the full-length sequence of which is disclosed as SEQ ID NO: 146 and the mature polypeptide of which is disclosed as SEQ ID NO: 147.

Strains

*Escherichia coli* Top10 strain, purchased from TIANGEN (TIANGEN Biotech Co. Ltd., Beijing, China), was used to propagate our expression constructs.

*Aspergillus oryzae* MT3568 is an amdS (acetamidase) disrupted derivative of *A. oryzae* JaL355 in which pyrG auxotrophy was restored by disrupting the *A. oryzae* acetamidase (amdS) gene with the pyrG gene.

The fungal strain NN058531 was isolated from soil samples collected from Guizhou Province, China, in 2014 by the dilution plate method with PDA medium pH3, 25° C. It was then purified by transferring a single conidium onto a PDA agar plate. The strain NN058531 was identified as

*Talaromyces* sp. XZ2925, based on both morphological characteristics and ITS rDNA sequence.

Genomic DNA Extraction

The *Talaromyces* sp. XZ2925 strain NN058531 was inoculated onto a PDA plate and incubated for 7 days at 25° C. in the darkness. Several mycelia-PDA plugs were inoculated into 500 ml shake flasks containing 100 ml of YPG medium. The flasks were incubated for 3 days at 25° C. with shaking at 160 rpm. The mycelia were collected by filtration through MIRACLOTH® (Calbiochem, La Jolla, CA, USA) and frozen under liquid nitrogen. Frozen mycelia were ground, by a mortar and a pestle, to a fine powder, and genomic DNA was isolated using DNEASY® Plant Maxi Kit (24) (QIAGEN GmbH, Hilden, Germany) following the manufacturer's instruction.

Genome Sequencing, Assembly and Annotation

The extracted genomic DNA samples of NN058531 were delivered to Novozymes Davis (USA) for genome sequencing using an ILLUMINA® MISEQ® System (Illumina, Inc., San Diego, CA, USA). The raw reads were assembled at Novozymes Denmark using program Spades (Anton Bankevich et al., 2012, *Journal of Computational Biology,* 19(5): 455-477). The assembled sequences were analyzed using standard bioinformatics methods for gene identification and function prediction. GeneMark-ES fungal version (Ter-Hovhannisyan V et al., 2008, *Genome Research* 18(12): 1979-1990) was used for gene prediction. Blastall version 2.2.10 (Altschul et al., 1990, *Journal of Molecular Biology,* 215(3): 403-410, ftp://ftp.ncbi.nlm.nih.gov/blast/executables/release/2.2.10/) and HMMER version 2.1.1 (National Center for Biotechnology Information (NCBI), Bethesda, MD, USA) were used to predict function based on structural homology. The GH28 family rhamnogalacturonase from *Talaromyces* sp. ZX2925 was identified directly by analysis of the Blast results. The Agene program (Munch and Krogh, 2006, *BMC Bioinformatics,* 7:263) and SignalP program (Nielsen et al., 1997, *Protein Engineering,* 10: 1-6) were used to identify start codons. SignalP program was further used to predict signal peptides. Pepstats (Rice et al., 2000, *Trends Genet,* 16(6): 276-277) was used to predict isoelectric points and molecular weights.

Example 19. Cloning, Expression and Fermentation of Fungal Pectinase Genes Characterized in Examples 13-18

The pectinase genes characterized in Examples 13-19 were amplified with primer pairs listed in Table 11 below, from the corresponding genomic DNAs as listed in Table 12, with isolations described in Examples 13-18.

TABLE 11

| gene-specific primer pair | |
|---|---|
| GH28 family rhamnogalacturonase from *Talaromyces calidicanius* (SEQ ID NO: 52) | |
| Forward primer<br>ACACAACTGGGGATCCACCATGAAAGCCCCTATTTTATCATTGTGTGCC | SEQ ID NO: 148 |
| Reverse primer<br>CCCTCTAGATCTCGAGCTAGTTCGAACATTGAACTCCTGAGACCC | SEQ ID NO: 149 |
| GH28 family rhamnogalacturonase from *Penicillium* sp. XZ2495 (SEQ ID NO: 55) | |
| Forward primer<br>ACACAACTGGGGATCCACCATGAAGTCTATTCTGAGTGTAGCCGTCTG | SEQ ID NO: 150 |
| Reverse primer<br>CCCTCTAGATCTCGAGTCAACATGTGATACCTGTTGAGCTCTGC | SEQ ID NO: 151 |
| GH28 family rhamnogalacturonase from *Penicillium* sp-54788 (SEQ ID NO: 58) | |
| Forward primer<br>ACACAACTGGGGATCCACCATGAGAGCCTTTGCTCTATATGTACTGGC | SEQ ID NO: 152 |
| Reverse primer<br>CCCTCTAGATCTCGAGCTAATTCTCCACCGCACAATTAGCACC | SEQ ID NO: 153 |
| PL4_1 rhamnogalacturonan lyase from *Sporormia fimetaria* (SEQ ID NO: 139) | |
| Forward primer<br>ACACAACTGGGGATCCACCATGCGCTACGTCACCTACGCT | SEQ ID NO: 154 |
| Reverse primer<br>CCCTCTAGATCTCGAGCTAGTCCTGTAACTCTATAGCATCTACGATGTAGT | SEQ ID NO: 155 |
| GH28 family polygalacturonase from *Penicillium oxalicum* (SEQ ID NO: 142) | |
| Forward primer<br>ACACAACTGGGGATCCACCATGGTTCTCAGTCTCAAACTCTGCCT | SEQ ID NO: 156 |
| Reverse primer<br>CCCTCTAGATCTCGAGCTAGCACTTGGCACTACCGGGA | SEQ ID NO: 157 |
| GH28 family rhamnogalacturonase from *Talaromyces* sp. XZ2925 (SEQ ID NO: 145) | |
| Forward primer<br>ACACAACTGGGGATCCACCATGAAGTCTATTCTGGCTGTATGCCTCT | SEQ ID NO: 158 |
| Reverse primer<br>CCCTCTAGATCTCGAGTTAACAGCTGATACCTGTCGAGCTCG | SEQ ID NO: 159 |

TABLE 12

| genomic DNA | | |
|---|---|---|
| DNA | Protein | Donor Organism of genomic DNA |
| SEQ ID NO: 52 | SEQ ID NO: 53 | NN058141 *Talaromyces calidicanius* |
| SEQ ID NO: 55 | SEQ ID NO: 56 | NN058240 *Penicillium* sp. XZ2495 |
| SEQ ID NO: 58 | SEQ ID NO: 59 | NN054788 *Penicillium* sp-54788 |
| SEQ ID NO: 139 | SEQ ID NO: 140 | NN047801 *Sporormia fimetaria* |
| SEQ ID NO: 142 | SEQ ID NO: 143 | NN051380 *Penicillium oxalicum* |
| SEQ ID NO: 145 | SEQ ID NO: 146 | NN058531 *Talaromyces* sp. XZ2925 |

The purified PCR products were cloned into the expression vector pCaHj505 (SEQ ID NO: 142) or pDau222 (SEQ ID NO: 52, 55, 58, 139, 145), both digested with BamHI/XhoI. The expression vector pCaHj505 was described in EP27481891B1 (incorporated herein by reference for its teachings pertaining to Example 3) and pDau222 was described in WO2013024021A1 (incorporated herein by reference for its teachings pertaining to Example 2).

The expression constructs harboring the correct coding sequences were confirmed and transformed into protoplasts of *Aspergillus oryzae* MT3568 (described in WO2014026630A1, incorporated herein by reference for its teachings pertaining to Example 2). MT3568 protoplasts were prepared according to the method of European Patent, EP02380231B2 (incorporated herein by reference for its teachings pertaining to Example 9)

The expression screening was made by inoculating 1~4 transformants of each gene in 3 ml of Dap4C medium in 24 well plate, shaking at 150 rpm, 300, for 3-4 days. The culture broths were then checked by NUPAGE® NOVEX® 4-12% Bis-Tris Gel w/MES (Invitrogen Corporation, Carlsbad, CA, USA) according to the manufacturer's instructions with SeeBlue® Plus2 Pre-stained Protein Standard (Thermo Fisher Scientific, Waltham, MA USA) as the protein marker. The resulting gel was stained with INSTANTBLUE™ (Expedeon Ltd., Babraham Cambridge, UK). All 6 genes showed positive expression with protein bands visualized approximately at 90 kDa for SEQ ID NO: 52; 85 kDa for SEQ ID NO: 55; 80 kDa for SEQ ID NO: 58; 55 kDa for SEQ ID NO: 139; 38 kDa for SEQ ID NO: 142 and 85 kDa for SEQ ID NO: 145. The expression strains were designated as O44MPW, O44MPY, O44MPZ, O44PYC, O43H5T and O44MPR accordingly.

A slant was made for each of the above-mentioned expression strains by inoculating the spores of isolated single colonies. The fully sporulated slant was used for inoculation of 4-6 shaking flasks of 2 L containing 400 ml of Dap4C medium each. After 4 days cultivation at 30° C., 80 rpm, the culture broths were harvested by using a 1000 ml Rapid-Flow Bottle Top Filter 0.2 um aPES membrane (ThermoFisher Scientific, Cat #597-4520). The filtered broth samples were purified as described in example 4.

Example 20. Purification of Recombinant Pectinases from *Aspergillus oryzae* O44MPW, O44MPY, O44MPZ, O44PYC, O43H5T and O44MPR A 2400 ml volume of filtered supernatant of *Aspergillus oryzae O*44MPW was precipitated with ammonium sulfate (80% saturation), the protein was re-dissolved in $ddH_2O$, followed by adjusting conductivity to 145 ms/cm with $(NH_4)_2SO_4$, and filtered through a 0.45 μm filter. The solution was applied to a 40 ml Phenyl Sepharose high performance column (GE Healthcare, Buckinghamshire, UK), proteins were washed with a linear 2.0-0 M $(NH_4)_2SO_4$ gradient. Fractions were analyzed by SDS-PAGE using a NUPAGE® NOVEX® 4-12% Bis-Tris Gel with 50 mM MES. The resulting gel was stained with INSTANTBLUE™. Fractions containing a band at approximately 90 kDa were pooled. Then the pooled solution was concentrated by ultrafiltration.

A 1600 ml volume of filtered supernatant of *Aspergillus oryzae* O44MPY was precipitated with ammonium sulfate (80% saturation), the protein was re-dissolved in $ddH_2O$, followed by adjusting conductivity to 145 ms/cm with $(NH4)_2SO_4$, and filtered through a 0.45 μm filter. The solution was applied to a 40 ml Phenyl Sepharose high performance column (GE Healthcare, Buckinghamshire, UK), proteins were washed with a linear 2.0-0 M $(NH_4)_2SO_4$ gradient. Fractions were analyzed by SDS-PAGE using a NUPAGE® NOVEX® 4-12% Bis-Tris Gel with 50 mM MES. The resulting gel was stained with INSTANTBLUE™. Fractions containing a band at approximately 85 kDa were pooled. Then the pooled solution was concentrated by ultrafiltration.

A 1600 ml volume of filtered supernatant of *Aspergillus oryzae* O44MPZ was precipitated with ammonium sulfate (80% saturation), the protein was re-dissolved in $ddH_2O$, followed by adjusting conductivity to 145 ms/cm with $(NH_4)_2SO_4$, and filtered through a 0.45 μm filter. The solution was applied to a 40 ml Phenyl Sepharose high performance column (GE Healthcare, Buckinghamshire, UK), proteins were washed with a linear 2.0-0 M $(NH_4)_2SO_4$ gradient. Fractions were analyzed by SDS-PAGE using a NUPAGE® NOVEX® 4-12% Bis-Tris Gel with 50 mM MES. The resulting gel was stained with INSTANTBLUE™. Fractions containing a band at approximately 80 kDa were pooled. Then the pooled solution was concentrated by ultrafiltration.

A 2400 ml volume of filtered supernatant of *Aspergillus oryzae* O44PYC was precipitated with ammonium sulfate (80% saturation), the protein was re-dissolved in $ddH_2O$, followed by adjusting conductivity to 145 ms/cm with $(NH_4)_2SO_4$, and filtered through a 0.45 μm filter. The solution was applied to a 40 ml Phenyl Sepharose high performance column (GE Healthcare, Buckinghamshire, UK), proteins were washed with a linear 2.0-0 M $(NH_4)_2SO_4$ gradient. Fractions were analyzed by SDS-PAGE using a NUPAGE® NOVEX® 4-12% Bis-Tris Gel with 50 mM MES. The resulting gel was stained with INSTANTBLUE™. Fractions containing a band at approximately 56 kDa were pooled. Then the pooled solution was concentrated by ultrafiltration.

A 1600 ml volume of filtered supernatant of *Aspergillus oryzae* O43H5T was precipitated with ammonium sulfate (80% saturation), the protein was re-dissolved in $ddH_2O$, followed by adjusting conductivity to 145 ms/cm with $(NH_4)_2SO_4$, and filtered through a 0.45 μm filter. The solution was applied to a 40 ml Phenyl Sepharose high performance column (GE Healthcare, Buckinghamshire, UK), proteins were washed with a linear 1.8-0 M $(NH_4)_2SO_4$ gradient. Fractions were analyzed by SDS-PAGE using a NUPAGE® NOVEX® 4-12% Bis-Tris Gel with 50 mM MES. The resulting gel was stained with INSTANTBLUE™. Fractions containing a band at approximately 37 kDa were pooled. Then the pooled solution was concentrated by ultrafiltration.

A 1600 ml volume of filtered supernatant of *Aspergillus oryzae* O44MPR was precipitated with ammonium sulfate (80% saturation), the protein was re-dissolved in $ddH_2O$, followed by adjusting conductivity to 145 ms/cm with $(NH_4)_2SO_4$, and filtered through a 0.45 μm filter. The solution was applied to a 40 ml Phenyl Sepharose high performance column (GE Healthcare, Buckinghamshire, UK), proteins were washed with a linear 2.0-0 M $(NH_4)_2SO_4$ gradient. Fractions were analyzed by SDS-PAGE using a NUPAGE® NOVEX® 4-12% Bis-Tris Gel with 50 mM MES. The resulting gel was stained with INSTANTBLUE™. Fractions containing a band at approximately 85 kDa were pooled. Then the pooled solution was concentrated by ultrafiltration.

The invention described and claimed herein is not to be limited in scope by the specific aspects herein disclosed, since these aspects are intended as illustrations of several aspects of the invention. Any equivalent aspects are intended to be within the scope of this invention. Indeed, various modifications of the invention in addition to those shown and described herein will become apparent to those skilled in the art from the foregoing description. Such modifications are also intended to fall within the scope of the appended claims. In the case of conflict, the present disclosure including definitions will control.

SEQUENCE LISTING (159 sequences)

SEQ ID NO: 1 - DNA, 1110 bp, Aspergillus niger
  CDS (1)..(1110)
  sig_peptide (1)..(57)
atgccttctgccaagcctttgttctgcctcgcgaccctggccggtgccgctctggctgctcctgcgccttcccgcgccaccgacttcaacaagcggtccacctgcaccttcactgatgctgccaccgcctccgagagcaagacctcctgctccgacatcgtcctcaaggacatcaccgtccctgccggtgagacccttaacctgaaggacctcaacgatggcaccaccgtcacctttgagggaaccaccacctgggagtacgaggagtgggacggacccctcctccgtatctccggtaaggacatcaccgttacccagtcctccgacgccgtcctcgacggcaatggtgctaagtggtgggacggtgagggaaccaacggcggcaagaccaagcccaagttcttctacgcccacgacctcgatgactccaagatctccggtctctacatcaagaacacccctgtccaggccatctccgttgagtcggacaacctcgtgatcgaggacgtcaccatcgacaacagcgacggtgactccgagggcggtcacaacaccgacggtttcgacatcagcgagagtacctacatcaccatcaccggtgccaccgtcaagaaccaggacgactgcgtcgccatcaactccggcgagaacatctacttctctggcggtacctgctccggcggtcacggtctgtccatcggctccgttggtggccgcgacgacaacaccgtcaagaacgtcaccttcatcgactccactgtctctgactccgagaacggtgttcgcatcaagactgtctacgacgctaccggtaccgtcgaggatatcacctactccaacatccagctctccggcatctccgactacggtatcgtcatcgagcaggactacgagaacggtgacccgaccggtaccccctccaacggtgttaccatctctgatgttaccctcgaggacatcactggctcggttgactctgatgctgtcgagatctacatcctttgcggtgacggcagctgctctgactggaccatgtccggcattgacatcaccggcggtgagaccagcagcgattgcgagaacgttccctctggcgcttcttgcgatcag

SEQ ID NO: 2 - protein, 370 aa, Aspergillus niger
MPSAKPLFCLATLAGAALAAPAPSRATDFNKRSTCTFTDAATASESKTSCSDIVLKDITVPAGETLNLKDLNDGTTVTFEGTTTWEYEEWDGPLLRISGKDITVTQSSDAVLDGNGAKWWDGEGTNGGKTKPKFFYAHDLDDSKISGLYIKNTPVQAISVESDNLVIEDVTIDNSDGDSEGGHNTDGFDISESTYITITGATVKNQDDCVAINSGENIYFSGGTCSGGHGLSIGSVGGRDDNTVKNVTFIDSTVSDSENGVRIKTVYDATGTVEDITYSNIQLSGISDYGIVIEQDYENGDPTGTPSNGVTISDVTLEDITGSVDSDAVEIYILCGDGSCSDWTMSGIDITGGETSSDCENVPSGASCDQ

SEQ ID NO: 3 - protein, 351 aa, Aspergillus niger
APAPSRATDFNKRSTCTFTDAATASESKTSCSDIVLKDITVPAGETLNLKDLNDGTTVTFEGTTTWEYEEWDGPLLRISGKDITVTQSSDAVLDGNGAKWWDGEGTNGGKTKPKFFYAHDLDDSKISGLYIKNTPVQAISVESDNLVIEDVTIDNSDGDSEGGHNTDGFDISESTYITITGATVKNQDDCVAINSGENIYFSGGTCSGGHGLSIGSVGGRDDNTVKNVTFIDSTVSDSENGVRIKTVYDATGTVEDITYSNIQLSGISDYGIVIEQDYENGDPTGTPSNGVTISDVTLEDITGSVDSDAVEIYILCGDGSCSDWTMSGIDITGGETSSDCENVPSGASCDQ

SEQ ID NO: 4 - DNA, 1160 bp, Aspergillus aculeatus
  sig_peptide (1)..(54)
  exon (1)..(231)
  Intron (232)..(281)
  exon (282)..(1160)
atgcactccttccagcttctcggcctggccgctgtcggctccgtcgtctcggccgctcctactgcgtctcgtgtctccgaccttgtgaagaagtcctcttctacctgcactttcacctctgccagcgaggctagcgaaagcatctcttcgtgctccaacgtcgtcctcagcaacatcgaggtgcccgccggagagacacttgacctgtccgacgccgctgacggtgccaccgtaagttttcctacaacagtcactagcttagacccagctaacgataccagatcacttttgagggtaccaccagcttcggctacgaggaatgggatggtcctcttatccgtttcggcggcaagcagctcaccatcacccagtctgacggtgctgtcattgacggtgatggctctcgctggtgggacagcgagggcaccaacggtggcaagaccaagcccaagttcatgtacgtccacgatgtcgaggattcgaccatcaagggcctgcagatcaagaacactccggtgcaggccatcagtgtgcaggcgaccaacgtctacctgaccgacatcaccatcgacaactccgacggtgacgacaacggtggccacaacaccgacggattcgacatcagcgagagtactggcgtgtacatcagcggtgctaccgtcaagaaccaggatgactgtatcgccatcaactccggcgagaacatcctcttcaccggcggtacctgctccggtggccacggtctgtccatcggctccgtgggtggccgtgatgacaacaccgtcaagaacgtgaccatctcggactcaaccgtcacggactcggccaacggtgtccgcatcaagaccatctacggcgacaccggtgatgttagcgagatcacctactccaacatccagctctccggcatcaccgactacggaattgtcatcgagcaggactacgagaacggcagccctactggtaccccctccactggtgtccccatcaccgacgtgaccgtcgatggtgtcaccggctcgatcgaggatgacgctgtccaggtctacatcctctgcggtgacggcagctgctccgactggacctggtccggcgttgacatcaccggtggtgagaccagctccgactgcgagaacgttccctccggcgcttcttgctag

SEQ ID NO: 5 - protein, 369 aa, Aspergillus aculeatus
MHSFQLLGLAAVGSVVSAAPTASRVSDLVKKSSSTCTFTSASEASESISSCSNVVLSNIEVPAGETLDLSDAADGATITFEGTTSFGYEEWDGPLIRFGGKQLTITQSDGAVIDGDGSRWWDSEGTNGGKTKPKFMYVHDVEDSTIKGLQIKNTPVQAISVQATNVYLTDITIDNSDGDDNGGHNTDGFDISESTGVYISGATVKNQDDCIAINSGENILFTGGTCSGGHGLSIGSVGGRDDNTVKNVTISDSTVTDSANGVRIKTIYGDTGDVSEITYSNIQLSGITDYGIVIEQDYENGSPTGTPSTGVPITDVTVDGVTGSIEDDAVQVYILCGDGSCSDWTWSGVDITGGETSSDCENVPSGASC

SEQ ID NO: 6 - protein, 351 aa, Aspergillus aculeatus
APTASRVSDLVKKSSSTCTFTSASEASESISSCSNVVLSNIEVPAGETLDLSDAADGATITFEGTTSFGYEEWDGPLIRFGGKQLTITQSDGAVIDGDGSRWWDSEGTNGGKTKPKFMYVHDVEDSTIKGLQIKNTPVQAISVQATNVYLTDITIDNSDGDDNGGHNTDGFDISESTGVYISGATVKNQDDCIAINSGENILFTGGTCSGGHGLSIGSVGGRDDNTVKNVTISDSTVTDSANGVRIKTIYGDTGDVSEITYSNIQLSGITDYGIVIEQDYENGSPTGTPSTGVPITDVTVDGVTGSIEDDAVQVYILCGDGSCSDWTWSGVDITGGETSSDCENVPSGASC

SEQ ID NO: 7 - DNA, 1470 bp, Aspergillus aculeatus
  sig_peptide (1)..(60)
  exon (1)..(261)
  Intron (262)..(354)
  exon (355)..(777)
  Intron (778)..(846)
  exon (847)..(976)
  Intron (977)..(1147)
  exon (1148)..(1470)
atgcaccttaacaccaccctactcgtctcgctcgccctcggggccgcgagcgtcctcgccagcccagccccaccagcaatcacggccccgcccacggccgaggagatcgcgaagcgcgcgacgacctgcacgttctccggatcgaacggcgcctcgtcggccagcaagtccaagacctcgtgctcgaccattgtgttgtcgaatgtggccgttccgtcggggacgacgctggacctgaccaagctgaacgacgggactcatgtagcctctccttactccaagccattgcccccgctccccttccctccactccacacctcaccttttgaccatcctctaacgataaacggataggtgatcttctcaggcgaaaccaccttcggctacaaggaatggagcggccccctgatctccgtctccgggagcgacctgaccatcaccggggcgagcgggcacagcatcaacggggacggcagccggtggtgggacggcgagggcgggaacgggggcaagacgaagcccaagttcttcgcggcgcacagcctgaccaactcggtgattagcgggctgaagatcgtcaactcgccggtgcaggttttcagcgttgcggggtcggattatctgaccctcaaggatatcacgatcgacaactcggacggcgacgacaatggcgggcataataccgatgcgtttgatatcggcacgagcacgtatgtcacgatctcgggcgccacggtgtataatcaggatgattgcgtggctgtgaattcgggggaggtgagttcacccctaagcgattgggtttgggggggggggagtggggtggtggctaacagcaccacgcagaatatctacttctcgggcggctactgctccggtggacacggcttgtccattggttcggtgggcggacgcagtgataatacggttaagaacgtgacgtttgtggattcgacgatcattaactcagataatggtgcgtttacctgagccccagcctctttcccttcaccacaggcccctatccctcagccctgcagtcccttccccttccccttccttcaccccctaatcaaccccaatcccaccaaccccagccctacccaatcctctcactctcaaaaccaagactaagagggagaaaaaggcgtccgcatcaaaaccaacatcgacaccaccggctccgtgtccgacgtcacctacaaggacatcacgctcacctccatcgccaagtacgggatcgtggtgcagcagaactacggcgacacgtcatcgacgcccacgacgggggtgccgatcacggactttgtgctggacaacgtgcacggctcggtggtcagctcggggaccaacatcctcatctcgtgcgggtcgggcagttgttcggattggacgtggacggatgtgagtgtcagtggggggaagacgagttccaagtgtacgaatgtgccgagtggggctagttgttga

SEQ ID NO: 8 - protein, 378 aa, Aspergillus aculeatus
MHLNTTLLVSLALGAASVLASPAPPAITAPPTAEEIAKRATTCTFSGSNGASSASKSKTSCSTIVLSNVAVPSGTTLDLTKLNDGTHVIFSGETTFGYKEWSGPLISVSGSDLTITGASGHSINGDGSRWWDGEGGNGGKTKPKFFAAHSLTNSVISGLKIVNSPVQVFSVAGSDYLTLKDITIDNSDGDDNGGHNTDAFDIGTSTYVTISGATVYNQDDCVAVNSGENIYFSGGYCSGGHGLSIGSVGGRSDNTVKNVTFVDSTIINSDNGVRIKTNIDTTGSVSDVTYKDITLTSIAKYGIVVQQNYGDTSSTPTTGVPITDFVLDNVHGSVVSSGTNILISCGSGSCSDWTWTDVSVSGGKTSSKCTNVPSGASC

SEQ ID NO: 9 - protein, 358 aa, Aspergillus aculeatus
SPAPPAITAPPTAEEIAKRATTCTFSGSNGASSASKSKTSCSTIVLSNVAVPSGTTLDLTKLNDGTHVIFSGETTFGYKEWSGPLISVSGSDLTITGASGHSINGDGSRWWDGEGGNGGKTKPKFFAAHSLTNSVISGLKIVNSPVQVFSVAGSDYLTLKDITIDNSDGDDNGGHNTDAFDIGTSTYVTISGATVYNQDDCVAVNSGENIYFSGGYCSGGHGLSIGSVGGRSDNTVKNVTFVDSTIINSDNGVRIKTNIDTTGSVSDVTYKDITLTSIAKYGIVVQQNYGDTSSTPTTGVPITDFVLDNVHGSVVSSGTNILISCGSGSCSDWTWTDVSVSGGKTSSKCTNVPSGASC

SEQ ID NO: 10 - DNA, 1202 bp, Aspergillus aculeatus
  sig_peptide (1)..(60)
  exon (1)..(216)
  Intron (217)..(268)
  exon (269)..(685)
  exon (744)..(1202)
atgcatttcatcaagtcctctatcttggctgccaccatgggcgctgcgctggtcgcagctgctcccaccgacatcgagaagcgctccagctgtaccttcaccgatgccgccaaggccaagtctggcaagacctcttgctcgaccatctacctcaacaacatcgaggttcccgctggtgaaacccttgatctgaccggcctcaagtcgggcaccactgtaggacgcccctgttcatgaatgcatggtgaaagctaatcattccccccaggttatcttcgagggtactaccactttcggctacaaggagtggaagggtcccctgatctccatgtccggtaccgacatcactgtcaagcaggcctccggcgccaagatcaactgcgatggttcccgctggtgggacggcaagggcagcaacggcggcaagaccaagcccaagttcttctatgcccacaagctggatcagtccagcatcactggactcaaggtctacaacacccccgtccagggcttcagcatccaggccgaccacctgaccctcaccgatgtgaccatcgacaactcctccggtacctccgagggccacaacaccgatgccttcgacattggctccagtacctacatcaccattgatggcgccaaggtctacaaccaggacgactgcttggccatcaactccggagaggtatttgctcggcctgccgactatattgttgattcaagcatctaataatgtcttctagcacatcactttcaccaacggctactgcagcggtggccacggtctctccatcggctccgtcggtggccgcagtgacaacactgtctccgacgtgaccatctccaactcccaggtcgtcaactcccagaacggtgtccgcatcaagaccgtctacgatgccaccggtaccgtcgagaacgtcaagttcgaggacatcaccctctccggcatcaccaagtacggtatcgtcgtcgagcaggactacgagaacggctcccccaccggtacccccaccaacggtatcagcgtcaaggacatcaccttcgagaaggtcaccggtaccgtcaagagctccgccactgacatctacctcctttgcggttccggcagctgctctgactggacctggtctggcgtcagcgtcactggcggcaagaagagctccaagtgcaagaacgttccttccggtgcctcttgctaa

SEQ ID NO: 11 - protein, 363 aa, Aspergillus aculeatus
MHFIKSSILAATMGAALVAAAPTDIEKRSSCTFTDAAKAKSGKTSCSTIYLNNIEVPAGETLDLTGLKSGTTVIFEGTTTFGYKEWKGPLISMSGTDITVKQASGAKINCDGSRWWDGKGSNGGKTKPKFFYAHKLDQSSITGLKVYNTPVQGFSIQADHLTLTDVTIDNSSGTSEGHNTDAFDIGSSTYITIDGAKVYNQDDCLAINSGEHITFTNGYCSGGHGLSIGSVGGRSDNTVSDVTISNSQVVNSQNGVRIKTVYDATGTVENVKFEDITLSGITKYGIVVEQDYENGSPTGTPTNGISVKDITFEKVTGTVKSSATDIYLLCGSGSCSDWTWSGVSVTGGKKSSKCKNVPSGASC

SEQ ID NO: 12 - protein, 343 aa, Aspergillus aculeatus
APTDIEKRSSCTFTDAAKAKSGKTSCSTIYLNNIEVPAGETLDLTGLKSGTTVIFEGTTTFGYKEWKGPLISMSGTDITVKQASGAKINCDGSRWWDGKGSNGGKTKPKFFYAHKLDQSSITGLKVYNTPVQGFSIQADHLTLTDVTIDNSSGTSEGHNTDAFDIGSSTYITIDGAKVYNQDDCLAINSGEHITFTNGYCSGGHGLSIGSVGGRSDNTVSDVTISNSQVVNSQNGVRIKTVYDATGTVENVKFEDITLSGITKYGIVVEQDYENGSPTGTPTNGISVKDITFEKVTGTVKSSATDIYLLCGSGSCSDWTWSGVSVTGGKKSSKCKNVPSGASC

SEQ ID NO: 13 - DNA, 1798 bp, Aspergillus aculeatus
  sig_peptide (1)..(66)
  exon (1)..(307)
  Intron (308)..(401)
  exon (402)..(771)
  Intron (772)..(829)
  exon (830)..(888)
  Intron (889)..(956)
  exon (957)..(1117)
  Intron (1118)..(1185)
  exon (1186)..(1374)
  Intron (1375)..(1448)
  exon (1449)..(1550)
  Intron (1551)..(1615)
  exon (1616)..(1690)
  Intron (1691)..(1750)
  exon (1751)..(1798)
atgagaacctcgcatcttcttagccaagcgctcggccttcttgcgctgggcgcgacagtggaaggcttcaaccgcgaccgaaaccaagcctgcgggcctcacaagcccttccagcctctgcccacgagcaagtccagaagcaagacttgccatgttcgcactcatggggacggatccgacgattcggcatatattctttctgccatcaagcaatgcaacaatggaggaaaggttgtcttcgacgccgacaaggaatacatcatcggcacggcgttggatctcactttcctgaagcacattgatcttggtgagtcgatgttgatcgttcttatttttaccttccttcctttgcttctttattaggtccatgtcatggtgactaaccctgacgtgctcaacagatatcgagggaaccatccaattcaccaacgataccgattactggcaagcgaatgctttccaacaggtcttccaaaatgcaacgaccttcttccagctcggtggtgaggacgtgaacgtttatggaggcggcactctggacggtaatggtcaagtctggtacgatctgtacgcagaggacgctcttatcctccgccctattctgtttggcattattggtctgaatgggggtaccattggcccgctgaacctgcgctattccccacaatggtacaacctcatcgccaactcgacaaacgttctctatgatggcatcaacatctctggatattccaagaacccgtccgtgactgctaagaacacggatggatggtacgttgctcttctttgttctgcagtagagggggtcggctaacgcttgttctgctagggacacttaccggtcctcgaacatcgtgattcaaaactctgtgatcaacaatggcgatggtacgtctccaaacccccgcgaaaccaatcaatagcgcacaaacctctaacaaagaatggattggtagactgcgtttccttcaaaccgaacagcactgacatcctggtgcaaaacctccactgcaacggctcgcacggtatctccgtgggctctctcggacaatacctgggcgaagtggacattgtacaggacattctcgtgtacaacatctccatgtacaatgcctcggtaagtgaaggctcatacataacgcagccgcttgagccacttcggcaccagtattgacccgtttacaggacatggctcgcatcaaggtctggcccggtgtctcgtccgctctctccgaggacctccagggtggcggtggcagcggtcgcgtgcagaatgtcacctatgacaccgcctacatcgacaatgtcgactgggcgatcgaagtgacccaatgctacggacagagcaacctgactctgtgcaacgaatacccggtgcgtacaccagaccccaaggggaaacccggctggaggtggtcgaattctaatgtgtcatgacaaaccaacagagcagtctcaccatctccgacgtctggttcaagaacttccgcggcaagacctctggaaaggagaatccttatgtcggaaccctggtttgctcgagccccgaggtgagtttctggatcggtagtaggcgagtcagaagaacgcaaaaagctgacagatgtcgcgataggtgtgctcgaacatctacaccgacaatatcaacgtcgtcagccccaagggcaccaacgactttgtctgcaataacgtaagttgattgtccccccgagttgtgcctggttcgaacttgttgctcatgctggattaggtggatacctcggacttgagcgtcaactgcacggcgacttcgagctag

SEQ ID NO: 14 - protein, 436 aa, Aspergillus aculeatus
MRTSHLLSQALGLLALGATVEGFNRDRNQACGPHKPFQPLPTSKSRSKTCHVRTHGDGSDDSAYILSAIKQCNNGGKVVFDADKEYIIGTALDLTFLKHIDLDIEGTIQFTNDTDYWQANAFQQVFQNATTFFQLGGEDVNVYGGGTLDGNGQVWYDLYAEDALILRPILFGIIGLNGGTIGPLNLRYSPQWYNLIANSTNVLYDGINISGYSKNPSVTAKNTDGWDTYRSSNIVIQNSVINNGDDCVSFKPNSTDILVQNLHCNGSHGISVGSLGQYLGEVDIVQDILVYNISMYNASDMARIKVWPGVSSALSEDLQGGGGSGRVQNVTYDTAYIDNVDWAIEVTQCYGQSNLTLCNEYPSSLTISDVWFKNFRGKTSGKENPYVGTLVCSSPEVCSNIYTDNINVVSPKGTNDFVCNNVDTSDLSVNCTATSS

SEQ ID NO: 15 - protein, 413 aa, Aspergillus aculeatus
NRDRNQACGPHKPFQPLPTSKSRSKTCHVRTHGDGSDDSAYILSAIKQCNNGGKVVFDADKEYIIGTALDLTFLKHIDLDIEGTIQFTNDTDYWQANAFQQVFQNATTFFQLGGEDVNVYGGGTLDGNGQVWYDLYAEDALILRPILFGIIGLNGGTIGPLNLRYSPQWYNLIANSTNVLYDGINISGYSKNPSVTAKNTDGWDTYRSSNIVIQNSVINNGDDCVSFKPNSTDILVQNLHCNGSHGISVGSLGQYLGEVDIVQDILVYNISMYNASDMARIKVWPGVSSALSEDLQGGGGSGRVQNVTYDTAYIDNVDWAIEVTQCYGQSNLTLCNEYPSSLTISDVWFKNFRGKTSGKENPYVGTLVCSSPEVCSNIYTDNINVVSPKGTNDFVCNNVDTSDLSVNCTATSS

SEQ ID NO: 16 - DNA, 1336 bp, Aspergillus aculeatus
  sig_peptide (1)..(60)
  exon (1)..(267)
  Intron (268)..(325)
  exon (326)..(748)
  Intron (749)..(825)
  exon (826)..(955)
  Intron (956)..(1013)
  exon (1014)..(1336)
atgctcgtcaactcggccgttctcctttcgctggccctcggggccatcaccgtcaacgccaactcggcccctgagccccctgcgatcaccgcagcgcccaaggtgggcgatttggagaaacgggcgaccacctgcacgttctcgggctccaacggcgcctcctcggcgagcaagtcgaagacctcctgctcgaccatcatcctctccagcgtggccgtcccatccggcacgaccctggacctgactgacctgaacgagggaacccacgtacgtattccgctccctttccacccttcctccgtaccctaaatggatgtcacgccaggtcatcttcgaaggcgaaaccaccttcggctacgaagaatgggccggcccgctggtctccgtctccggcacggacatcaccgtgaccggggccagcggggcgtacctcaacggcgacggcagccgctggtgggacgacgagggctcgaacgggggcaagaccaagcccaagttcttctatgcgcacgatctgaccgactcggtcatcagcggcatctacatccagaactccccggtgcaggtgttcagcgtcgacaactccaactacctgaccctggaggacatcaccatcgacaacacggacggtgacgatgacggcgccgcgaacacggacgggttcgatatcggcgacagcacctacatcaccatcaccggcgcgaacgtgtacaaccaggatgactgcgtcgcgatcaactcgggcgaggtacgtcctgaatggcccccaacctcccccttcttttccaagacaggatcgaacaacaactgacccaaactgtacagaacatctatttctccggcggcgtctgctccggcggccacggcttgtccatcggctccgtcggcggccgcagcgacaacaccgtcaagaacgtgaccttctacaactcggagatcaagaactcgcagaacggtaggcctctccttgcccaaaagaacaagtcaagttccgcataagctaacaaccccaggcgtccgcatcaaaaccatctacggcgacaccggctccgtctccgaggtgacctaccaggagatcacgctctccgagatcaccgagtacgggatcatcgtggagcagaactacgacgacacctcggaggcggccaccaccggcgttccgatcacggatttcgtcctcgatggcgtgcagggcaccgtcgagagcacgggcactgatatttatattgtgtgcggctcgggcagttgctccgactggacgtggacggatgtgagtgtctccggtgggaagacgagttcgtcgtgcacgaatgtgccgagtgggattagttgttag

SEQ ID NO: 17 - protein, 380 aa, Aspergillus aculeatus
MLVNSAVLLSLALGAITVNANSAPEPPAITAAPKVGDLEKRATTCTFSGSNGASSASKSKTSCSTIILSSVAVPSGTTLDLTDLNEGTHVIFEGETTFGYEEWAGPLVSVSGTDITVTGASGAYLNGDGSRWWDDEGSNGGKTKPKFFYAHDLTDSVISGIYIQNSPVQVFSVDNSNYLTLEDITIDNTDGDDDGAANTDGFDIGDSTYITITGANVYNQDDCVAINSGENIYFSGGVCSGGHGLSIGSVGGRSDNTVKNVTFYNSEIKNSQNGVRIKTIYGDTGSVSEVTYQEITLSEITEYGIIVEQNYDDTSEAATTGVPITDFVLDGVQGTVESTGTDIYIVCGSGSCSDWTWTDVSVSGGKTSSSCTNVPSGISC

SEQ ID NO: 18 - protein, 359 aa, Aspergillus aculeatus
SAPEPPAITAAPKVGDLEKRATTCTFSGSNGASSASKSKTSCSTIILSSVAVPSGTTLDLTDLNEGTHVIFEGETTFGYEEWAGPLVSVSGTDITVTGASGAYLNGDGSRWWDDEGSNGGKTKPKFFYAHDLTDSVISGIYIQNSPVQVFSVDNSNYLTLEDITIDNTDGDDDGAANTDGFDIGDSTYITITGANVYNQDDCVAINSGENIYFSGGVCSGGHGLSIGSVGGRSDNTVKNVTFYNSEIKNSQNGVRIKTIYGDTGSVSEVTYQEITLSEITEYGIIVEQNYDDTSEAATTGVPITDFVLDGVQGTVESTGTDIYIVCGSGSCSDWTWTDVSVSGGKTSSSCTNVPSGISC

SEQ ID NO: 19 - DNA, 1552 bp, Aspergillus aculeatus
  sig_peptide (1)..(60)
  exon (1)..(351)
  Intron (352)..(415)
  exon (416)..(583)
  Intron (584)..(636)
  exon (637)..(810)
  Intron (811)..(855)
  exon (856)..(1101)
  Intron (1102)..(1150)
  exon (1151)..(1552)
atgaagctcgtttcaattgctgcgcttctcctgggcgccgtgcctgttgccgtgaacgccgctgccgtgggcggaacccccaatggagccaagatcataccagtctctgatgcagctggcttgagaagtgtgggagcgcattcttccaagtacccgaaccgcaagactgtgacaatccgtccatccaagaacgactacgacgatatctcgagtgatttcctttggggaatcaagcaggccaaccacggcggacggctgctgctcgagaagggcaagaagtatgtgattggaaagaagttggatctgacattcttggacaatattgaggtgcagctggagggtgaactgaaggtatgttatccaatgctcggaggcaaccctggggaggcaagataactgacccagatggttgtagttcacgaacaacatcacctactggcaagcaaacaactactactatgacttccaaaagtcaatcacattttggcgctggggtggaaacgatatcaagatcttcggcagtggcacgttgaacggcaacggacaggcttggtacaatgcgtttgctggactcgagatcttggtaggtttttttcacctctcgcataagctcaatgttcagggctgacaaggcaggactcctccaacaccttctaccggccgattctgttcctgaccgacaacgcgacacgtgtatctgtggagggtatcacacagttgaattcgccatgctggaccaactttttcgtcaacaccaaggacatctcctttgatgatgtgtatatccatgctttttcgaccaacgcttcggtatgtcaaagcgcgtcaggccccgaaagctggctaacagcataggctctcccgaaaaacaccgacggatttgattcgtacaacgtcgatggcctgacggtcaccaacacccgcgtcgatatcggcgatgattgcttctcgcccaaacccaacaccaccaacatctttgtccaaaacctgtggtgcaacaacacgcacggtgtgagtatgggcagtattggacaatacccaggagaactggacatcattgaaaacgcctggattgagaacgtgacgctgctgaatggccaggtaggtgcaactagacaattgtcttgttgatcgaggctaacaaacatagaacggcgctcgactcaaggcctgggctggaccagatgtgggatacggtcgcatcaacaacattacctacaagaacatccagattcagaacaccgacaacccagtagtgctggaccagtgctacttcgacatcaatgccacagagtgcgcccagtacccgtcttctgtcaacatcacgaacatcctttttcagaacatctggggtacctcctcaggaaaggaaggtctagtggttgccgatctaacgtgctcgcctgccgctgtctgcacgaatgtcaccctgcaggatgtctcgctgacgagtccggcgggcagcccggcggagattatctgctctggcattacggggggcattggagtggattgtgtggatgaaatcaactcaacctcgaccaagcgatag

SEQ ID NO: 20 - protein, 446 aa, Aspergillus aculeatus
MKLVSIAALLLGAVPVAVNAAAVGGTPNGAKIIPVSDAAGLRSVGAHSSKYPNRKTVTIRPSKNDYDDISSDFLWGIKQANHGGRLLLEKGKKYVIGKKLDLTFLDNIEVQLEGELKFTNNITYWQANNYYYDFQKSITFWRWGGNDIKIFGSGTLNGNGQAWYNAFAGLEILDSSNTFYRPILFLTDNATRVSVEGITQLNSPCWTNFFVNTKDISFDDVYIHAFSTNASALPKNTDGFDSYNVDGLTVTNTRVDIGDDCFSPKPNTTNIFVQNLWCNNTHGVSMGSIGQYPGELDIIENAWIENVTLLNGQNGARLKAWAGPDVGYGRINNITYKNIQIQNTDNPVVLDQCYFDINATECAQYPSSVNITNILFQNIWGTSSGKEGLVVADLTCSPAAVCTNVTLQDVSLTSPAGSPAEIICSGITGGIGVDCVDEINSTSTKR

SEQ ID NO: 21 - protein, 425 aa, Aspergillus aculeatus
AVGGTPNGAKIIPVSDAAGLRSVGAHSSKYPNRKTVTIRPSKNDYDDISSDFLWGIKQANHGGRLLLEKGKKYVIGKKLDLTFLDNIEVQLEGELKFTNNITYWQANNYYYDFQKSITFWRWGGNDIKIFGSGTLNGNGQAWYNAFAGLEILDSSNTFYRPILFLTDNATRVSVEGITQLNSPCWTNFFVNTKDISFDDVYIHAFSTNASALPKNTDGFDSYNVDGLTVTNTRVDIGDDCFSPKPNTTNIFVQNLWCNNTHGVSMGSIGQYPGELDIIENAWIENVTLLNGQNGARLKAWAGPDVGYGRINNITYKNIQIQNTDNPVVLDQCYFDINATECAQYPSSVNITNILFQNIWGTSSGKEGLVVADLTCSPAAVCTNVTLQDVSLTSPAGSPAEIICSGITGGIGVDCVDEINSTSTKR

SEQ ID NO: 22 - DNA, 1155 bp, Aspergillus aculeatus
  sig_peptide (1)..(57)
  CDS (1)..(1155)
atggttcgtcagcttgcattggcctgcggactgctggcagcagtggccgtccaggcagcccccgcggaaccggctcatccgatggtgactgaagcgccggacgccagcctcctccacaagcgagccaccacttgcaccttctcaggctctgagggagcgtccaaagtgagcaagtccaagacggcctgctccaccatctacctgtccgccctggctgtcccctccggtaccaccctggacttgaaggacctaaacgacggaactcacgtcatcttcgaaggcgagaccaccttcgggtacgaagaatgggagggcccgctcgtctccgtatccggaaccgatatcacggtcgagggcgcaagtggtgccgttttgaacggcgatggcagccgctggtgggatggagagggaggtaacggtggcaagactaagcccaaattctttgcggcccacgacttgacttcctcgacgatcaagagcatctatatcgagaactccccggtgcaggtcttcagtatcgatggtgcgaccgatctgactttgacagacatcaccattgacaacactgatggtgatacggatgatcttgctgctaacaccgatggtttcgacattggagagagcaccgacatcacaatcacgggagccaaggtctacaaccaggatgactgtgttgccatcaattctggcgagaacatctacttcagtgccagtgtgtgctccggtggccatgggctgtccattggctctgtcggcggtcgggatgataacacggtgaagaacgtcaccttctacgatgtcaatgttctcaagtctcagcaagctatccgtatcaaggccatctacggagacactggctccattagcgacatcacctatcatgagatagctttctcggatgccacagactacggtattgtcatcgagcagaattacgatgatacctctaagaccccaaccactggcgttcccatcacggatttcaccctcgagaacgtgattggtacttgtgcggacgacgactgcaccgaggtttacattgcgtgtggtagtggcgcctgctcggactggagctggtccagcgtgagtgtcacgggcggcaaggtcagctccaagtgcctgaatgtcccctccgggataagctgcgacttgtag

SEQ ID NO: 23 - protein, 384 aa, Aspergillus aculeatus
MVRQLALACGLLAAVAVQAAPAEPAHPMVTEAPDASLLHKRATTCTFSGSEGASKVSKSKTACSTIYLSALAVPSGTTLDLKDLNDGTHVIFEGETTFGYEEWEGPLVSVSGTDITVEGASGAVLNGDGSRWWDGEGGNGGKTKPKFFAAHDLTSSTIKSIYIENSPVQVFSIDGATDLTLTDITIDNTDGDTDDLAANTDGFDIGESTDITITGAKVYNQDDCVAINSGENIYFSASVCSGGHGLSIGSVGGRDDNTVKNVTFYDVNVLKSQQAIRIKAIYGDTGSISDITYHEIAFSDATDYGIVIEQNYDDTSKTPTTGVPITDFTLENVIGTCADDDCTEVYIACGSGACSDWSWSSVSVTGGKVSSKCLNVPSGISCDL

SEQ ID NO: 24 - protein, 364 aa, Aspergillus aculeatus
PAEPAHPMVTEAPDASLLHKRATTCTFSGSEGASKVSKSKTACSTIYLSALAVPSGTTLDLKDLNDGTHVIFEGETTFGYEEWEGPLVSVSGTDITVEGASGAVLNGDGSRWWDGEGGNGGKTKPKFFAAHDLTSSTIKSIYIENSPVQVFSIDGATDLTLTDITIDNTDGDTDDLAANTDGFDIGESTDITITGAKVYNQDDCVAINSGENIYFSASVCSGGHGLSIGSVGGRDDNTVKNVTFYDVNVLKSQQAIRIKAIYGDTGSISDITYHEIAFSDATDYGIVIEQNYDDTSKTPTTGVPITDFTLENVIGTCADDDCTEVYIACGSGACSDWSWSSVSVTGGKVSSKCLNVPSGISCDL

SEQ ID NO: 25 - DNA, 1226 bp, Thermoascus crustaceus
  sig_peptide (1)..(60)
  exon (1)..(234)
  Intron (235)..(286)
  exon (287)..(706)
  Intron (707)..(767)
  exon (768)..(1226)
atgcatgtgtttgtttcctttatacacttggtcagcgctggcgctggtctcgtgtctgctattccaggcccctcccgtgccacgcagctcaatgaacgagccgaaagctgcactttcaccgatgctgccaaggccattgaaagcaaaacctcttgttcgacaattacactgaagaacattgaagtccctggtggagaaacactcgatctaacgaacttgaatgatgacaccagagtacatccgtgatacctcttgctcgcgattactaatactaacaggaaccaaggtcgtctttgaaggggaaaccaccttcggatacgctgaatggagtggccctcttgtctccatttcaggcacgggaatcactgttgaaggcgcccctgactctgttctgaacggtgatggatcccgttggtgggacgggcaaggcagcaatggtggtgtcacgaagccgaaattcttctacgcgcatcacctggattcatctagcatcacgggtatcacgatcaagaactctccagtccatgtgttcagcatccaggcgaaagatctgatgcttgccaatattactgtcgacaattcggatggggacacccaaggcggccacaatacggatgcatttgatgttggtgaaagctccggcatcaccatcgtcggagccaacgtaaagaatcaggatgactgccttgctgtcaactcaggcgaagtgagtgcagctttttaacatctatccttcccattacatatttagcagctcattatatcagaatattgtctttaccagtggtacctgctctggcggccatggcctctcaatcggttccgtcggtggccgggatgacaacaccgtgaagaacgtcacaatcagtgattccagtgtttctgactcccagaatggcatccgcatcaagactgtgtacaatgccaccggctccgtctccgacattacatactccaatatccaactttctggcatcacaaagtatggcatagtcattgagcaggactatgagaatggcagcccaaccggggaacctactaatggtatcccgatcacaggacttgctatcgatgaagttacagggatggtcgaggatgatgcaactaagatctacatcctctgcggagagggaagttgttctgactggacctggaaggatgtgaacatctctggcggcaaggctagcgatgaatgtgagaatgtccctgagggagtctcgtgctga

SEQ ID NO: 26 - protein, 258 aa, Thermoascus crustaceus
VLNGDGSRWWDGQGSNGGVTKPKFFYAHHLDSSSITGITIKNSPVHVFSIQAKDLMLANITVDNSDGDTQGGHNTDAFDVGESSGITIVGANVKNQDDCLAVNSGENIVFTSGTCSGGHGLSIGSVGGRDDNTVKNVTISDSSVSDSQNGIRIKTVYNATGSVSDITYSNIQLSGITKYGIVIEQDYENGSPTGEPTNGIPITGLAIDEVTGMVEDDATKIYILCGEGSCSDWTWKDVNISGGKASDECENVPEGVSC

SEQ ID NO: 27 - protein, 349 aa, Thermoascus crustaceus
PGPSRATQLNERAESCTFTDAAKAIESKTSCSTITLKNIEVPGGETLDLTNLNDDTRVVFEGETTFGYAEWSGPLVSISGTGITVEGAPDSVLNGDGSRWWDGQGSNGGVTKPKFFYAHHLDSSSITGITIKNSPVHVFSIQAKDLMLANITVDNSDGDTQGGHNTDAFDVGESSGITIVGANVKNQDDCLAVNSGENIVFTSGTCSGGHGLSIGSVGGRDDNTVKNVTISDSSVSDSQNGIRIKTVYNATGSVSDITYSNIQLSGITKYGIVIEQDYENGSPTGEPTNGIPITGLAIDEVTGMVEDDATKIYILCGEGSCSDWTWKDVNISGGKASDECENVPEGVSC

SEQ ID NO: 28 - DNA, 1730 bp, Aspergillus luchuensis
  sig_peptide (1)..(51)
  exon (1)..(300)
  Intron (301)..(351)
  exon (352)..(660)
  Intron (661)..(713)
  exon (714)..(859)
  Intron (860)..(917)
  exon (918)..(1371)
  Intron (1372)..(1448)
  exon (1449)..(1730)
atgatgaagcgcagcgcgctccttgcctctttccttcctctcgccctggggtgcgacaaccctgagactcactcctgtgcctctgccttctccgtctcctctgcggcggccgctaccttctgtgccaccttcacggcgagcaccgtgactgccacgactggtgtgccggatgtcttcctctccaactgcgactacaagaccaagcatctctccagtgcctgcagctgcttgggcacctctgacggatctgctcccgcttccaccccggctgccccggcagtctccagcagcagcaaagtggtgagcaccaaccagatgcctcattacgattcttctactgaaccaatgtagggcaaggcacctgctgttgcagccacccgcacctcggcgatccctactactttccacaccactccaattcgtgtgcccgtgtccaccccagcagcggcggctgtgactacccaggctgtcgtcccggtgcagagctccgtggcaggcaatggcggcaccacttgcacggtgactgagtacgcctcaatctcctccgccgtcgcatcctgctccaacatcctcctgtcgaacatcaacgcccctgcatcgagcacaattgatctttcgggcctgcagactggcgcggctgtcatcttcgctggtgaaaccgtaagccacctcccctatatcagggccaaccaccatactaacggaaccgatagaccttcggcgacacctacgacagcgacttcgatcccattgtcatctccggtaccgacgtgaccatcaccggtgaggagggacatgtcatcaacggtaacggtgaagcctactgggacggcgagggatccaacggcggacaggacaagtgagctcctaccagcacccccctattccggaatggcttcactaaccttccctgccaggcctgaccacttcatcgttgtcaaggacatgtacaactccaagatcgagaacctcaacatcctgaactaccccgtccactgcttcgagatcgaagacaccgagtacctcaccatcaccggcctgatcctcaacaacaccgccggtgatgccgccaacagcaagagtgacggcgacccggccgcccacaacaccgacggcttcgacatcaagcagagcgacttcctgaccctgtccaacacctgggtgcacaaccaggacgactgtgtcgccgtcactagcggtagctccatcgtcgtcgacaacctctactgctacggtggccacggtctctccatcggctccatcggcggcaagagcaacaacaccgtcaacggcgtcaccttctccaactcccaggtcattaacagcgagaacggctgccgcatcaagtccaacgctgataccactggcgaggttagtcatctgccccaatccataatacacccctcatcaaaacgtaaacactaaccaccgagacaatcattatacaggtctacaacgtccgctacgagaacatcaccctgtccggtatcaccgactacggcatcgacgtccagcaggactacgagaacggtggtgccaccggtgacccgaccaacgacgtcaagatcgagaacatctctttcgtcaacgtcaagggtactatgagcgacggcaaggattactacatcctctgcggtgatggcagctgctccaactttgtcttcactgatgtcgacatcaccggtggtagcgatgatagctgcaactacccctcttcgggatgtccttag

SEQ ID NO: 29 - protein, 496 aa, Aspergillus luchuensis
MMKRSALLASFLPLALGCDNPETHSCASAFSVSSAAAATFCATFTASTVTATTGVPDVFLSNCDYKTKHLSSACSCLGTSDGSAPASTPAAPAVSSSSKVGKAPAVAATRTSAIPTTFHTTPIRVPVSTPAAAAVTTQAVVPVQSSVAGNGGTTCTVTEYASISSAVASCSNILLSNINAPASSTIDLSGLQTGAAVIFAGETTFGDTYDSDFDPIVISGTDVTITGEEGHVINGNGEAYWDGEGSNGGQDKPDHFIVVKDMYNSKIENLNILNYPVHCFEIEDTEYLTITGLILNNTAGDAANSKSDGDPAAHNTDGFDIKQSDFLTLSNTWVHNQDDCVAVTSGSSIVVDNLYCYGGHGLSIGSIGGKSNNTVNGVTFSNSQVINSENGCRIKSNADTTGEVYNVRYENITLSGITDYGIDVQQDYENGGATGDPTNDVKIENISFVNVKGTMSDGKDYYILCGDGSCSNFVFTDVDITGGSDDSCNYPSSGCP

SEQ ID NO: 30 - protein, 478 aa, Aspergillus luchuensis
DNPETHSCASAFSVSSAAAATFCATFTASTVTATTGVPDVFLSNCDYKTKHLSSACSCLGTSDGSAPASTPAAPAVSSSSKVGKAPAVAATRTSAIPTTFHTTPIRVPVSTPAAAAVTTQAVVPVQSSVAGNGGTTCTVTEYASISSAVASCSNILLSNINAPASSTIDLSGLQTGAAVIFAGETTFGDTYDSDFDPIVISGTDVTITGEEGHVINGNGEAYWDGEGSNGGQDKPDHFIVVKDMYNSKIENLNILNYPVHCFEIEDTEYLTITGLILNNTAGDAANSKSDGDPAAHNTDGFDIKQSDFLTLSNTWVHNQDDCVAVTSGSSIVVDNLYCYGGHGLSIGSIGGKSNNTVNGVTFSNSQVINSENGCRIKSNADTTGEVYNVRYENITLSGITDYGIDVQQDYENGGATGDPTNDVKIENISFVNVKGTMSDGKDYYILCGDGSCSNFVFTDVDITGGSDDSCNYPSSGCP

SEQ ID NO: 31 - DNA, 1476 bp, Aspergillus aculeatus
  sig_peptide (1)..(54)
  CDS (1)..(1476)
atgcagcagcgcagtgcgctccttttggccctggcggcgcctctggcgctggcctgtgatagccctgaaaaccacgcttgtgcctccatctactctgtttcctccgtggctgcagccagcttctgcgccaccttcaccgccagcgcggtgagcgagacgaccggcgtgccggacgccttcctgtcggcctgcgactacaagaccaagcacctgtccagcgcctgcagctgtctgggccctgtcaccggtgctgccgcggccgccaccagcgtgagcaccacagcccccgtcgtcgtcgccacctccacgaccgccgccgccgcctccaccttccagacctcctcgaaggtggcctcgaccagccaagcggcgtccacgacgctggcccccgtcaccaccgaggtcgccgtggcggccacctcggccgtcggcaacggcggcacaacctgcacggtgaccgagtacgcgtccatctcgtcggcggtggcctcgtgctccaacatcctgctgtcgggcgtcagcgccccggcgtccagcacgatcgacctgaccgggctgcagacgggcgcagccgtgatcttcgccggtgaaaccaccttcggcgacacctacgacagcgacttcgacccgatcgtgatctccggcacggacctgaccatcaccggggcggagggccacgtcatcgacggcaacggccaagcctactgggacggcgagggttccaacggcggacaagacaaaccggaccacttcatcgtcgtcaagaaaatctacaacagcacgatcagcaacctgtacatccaaaactggccggtgcactgcttcgacatcgaatcgagcgagggcctcacgctcaccggaatcaccctgaacaacacggcgggcgacagccccaacagcctgagcggcgacgacccggccgcccacaacagcgacggcttcgacatcaagtcctcgaccgacctgaccctgaccgacagctgggtgcacaaccaggacgactgcgtcgccatcacctcgggctccaacatcctcgtcgacaacctctactgcgccggcggccacgggctgagcatcggctccatcggcggcaagtccgacaacaccgtcgacggcgtcaccttcagcaactcgcaggtcgtcgactccgagaacggctgccgcatcaagaccaactccggcgagaccggcgaggtctacaacatccgctacgagaatatcaccctctccggcatctcggactacggcatcgacgtccagcaggattatttgaacggcgggcccaccggcgagcccacgaatggggtcatgattgagaatgtcacgtttgtggatgtcaccggcaccatgagtgatggcaaggattactatatcctgtgtggcgatgggagctgtgaaaactttacgttcgagggcgtgagtattaccggcgggagtggggatagttgcaattatccggatagtgggtgtccttag

SEQ ID NO: 32 - protein, 491 aa, Aspergillus aculeatus
MQQRSALLLALAAPLALACDSPENHACASIYSVSSVAAASFCATFTASAVSETTGVPDAFLSACDYKTKHLSSACSCLGPVTGAAAAATSVSTTAPVVVATSTTAAAASTFQTSSKVASTSQAASTTLAPVTTEVAVAATSAVGNGGTTCTVTEYASISSAVASCSNILLSGVSAPASSTIDLTGLQTGAAVIFAGETTFGDTYDSDFDPIVISGTDLTITGAEGHVIDGNGQAYWDGEGSNGGQDKPDHFIVVKKIYNSTISNLYIQNWPVHCFDIESSEGLTLTGITLNNTAGDSPNSLSGDDPAAHNSDGFDIKSSTDLTLTDSWVHNQDDCVAITSGSNILVDNLYCAGGHGLSIGSIGGKSDNTVDGVTFSNSQVVDSENGCRIKTNSGETGEVYNIRYENITLSGISDYGIDVQQDYLNGGPTGEPTNGVMIENVTFVDVTGTMSDGKDYYILCGDGSCENFTFEGVSITGGSGDSCNYPDSGCP

SEQ ID NO: 33 - protein, 472 aa, Aspergillus aculeatus
DSPENHACASIYSVSSVAAASFCATFTASAVSETTGVPDAFLSACDYKTKHLSSACSCLGPVTGAAAAATSVSTTAPVVVATSTTAAAASTFQTSSKVASTSQAASTTLAPVTTEVAVAATSAVGNGGTTCTVTEYASISSAVASCSNILLSGVSAPASSTIDLTGLQTGAAVIFAGETTFGDTYDSDFDPIVISGTDLTITGAEGHVIDGNGQAYWDGEGSNGGQDKPDHFIVVKKIYNSTISNLYIQNWPVHCFDIESSEGLTLTGITLNNTAGDSPNSLSGDDPAAHNSDGFDIKSSTDLTLTDSWVHNQDDCVAITSGSNILVDNLYCAGGHGLSIGSIGGKSDNTVDGVTFSNSQVVDSENGCRIKTNSGETGEVYNIRYENITLSGISDYGIDVQQDYLNGGPTGEPTNGVMIENVTFVDVTGTMSDGKDYYILCGDGSCENFTFEGVSITGGSGDSCNYPDSGCP

SEQ ID NO: 34 - DNA, 1160 bp, Aspergillus luchuensis
  sig_peptide (1)..(57)
  exon (1)..(228)
  Intron (229)..(275)
  exon (276)..(1160)
atgccttctgccaagcctttgttctgcctcgcgaccctggccggtgccgctctggctgctcctgcgccttcccgcgccaccgacttcaacaagcggtccacctgcaccttcactgatgctgccaccgcctccgagagcaagacctcctgctccgacatcgtcctcaaggacatcaccgtccctgccggtgagacccttaacttgaaggacctcaacgatggcaccaccgtaagcctctcccggccctagcgtcagccccgttctaacgactccaggtcacctttgagggaaccaccacctgggagtacgaggagtgggacggacccctcctccgtatctccggtaaggacatcaccgttacccagtcctccgacgccgtcctcaacggcaacggtgctaagtggtgggacggtgagggaaccaacggcggcaagaccaagcccaagttcttctacgcccatgacctcgatgactccaagatctccggtctctacatcaagaacacccctgtccaggccatctccgtcgagtcggacaacctcgtgatcgaggacgtcaccatcgacaacagcgacggtgattccgagggcggccacaacaccgacggtttcgacatcagcgagagtacctacatcaccatcaccggcgccaccgtcaagaaccaggacgactgcgtcgccatcaactccggcgagaacatctacttctccggcggtacctgctccggcggtcacggtctgtccatcggctccgttggtggccgcgacgacaacaccgtcaagaacgtcaccttcatcgactcgactgtctctgactccgagaacggtgttcgcatcaagaccgtttatgatgctaccggtaccgtcgaggacatcacctactccaacatccagctctccggcatctccgactacggtattgtcatcgagcaggactacgagaacggtgaccctaccggtaccccctccaacggtgttaccatctccgatgttaccctcgaggatatcactggctcggttgactccgacgctgttgagatctacatcctttgcggtgacggcagctgcactgactggaccatgtccggcattgacatcaccggcggtgagaccagcagcgattgcgagaatgttccctctggcgcttcctgcagtcagtaa

SEQ ID NO: 35 - protein, 370 aa, Aspergillus luchuensis
MPSAKPLFCLATLAGAALAAPAPSRATDFNKRSTCTFTDAATASESKTSCSDIVLKDITVPAGETLNLKDLNDGTTVTFEGTTTWEYEEWDGPLLRISGKDITVTQSSDAVLNGNGAKWWDGEGTNGGKTKPKFFYAHDLDDSKISGLYIKNTPVQAISVESDNLVIEDVTIDNSDGDSEGGHNTDGFDISESTYITITGATVKNQDDCVAINSGENIYFSGGTCSGGHGLSIGSVGGRDDNTVKNVTFIDSTVSDSENGVRIKTVYDATGTVEDITYSNIQLSGISDYGIVIEQDYENGDPTGTPSNGVTISDVTLEDITGSVDSDAVEIYILCGDGSCTDWTMSGIDITGGETSSDCENVPSGASCSQ

SEQ ID NO: 36 - protein, 350 aa, Aspergillus luchuensis
PAPSRATDFNKRSTCTFTDAATASESKTSCSDIVLKDITVPAGETLNLKDLNDGTTVTFEGTTTWEYEEWDGPLLRISGKDITVTQSSDAVLNGNGAKWWDGEGTNGGKTKPKFFYAHDLDDSKISGLYIKNTPVQAISVESDNLVIEDVTIDNSDGDSEGGHNTDGFDISESTYITITGATVKNQDDCVAINSGENIYFSGGTCSGGHGLSIGSVGGRDDNTVKNVTFIDSTVSDSENGVRIKTVYDATGTVEDITYSNIQLSGISDYGIVIEQDYENGDPTGTPSNGVTISDVTLEDITGSVDSDAVEIYILCGDGSCTDWTMSGIDITGGETSSDCENVPSGASCSQ

SEQ ID NO: 37 - DNA, 1305 bp, Aspergillus aculeatus
  sig_peptide (1)..(63)
  exon (1)..(231)
  Intron (232)..(326)
  exon (327)..(746)
  Intron (747)..(846)
  exon (847)..(1305)
atgccttctatccagtcttccctgctttgcgctgccaccctggccactgctttggtgtctgctgcccctgccacccgtgcttcggactttgccaagcgctccacctgcaccttcacctcagctgctcaggcctccgagagtaagacttcctgcacggacatcgttctcaaggacatcaccgttcctgctggtgagactctcaacctcaaggacctgaagagcggtaccaccgtaagttcctgcctcaaccccagtatctctcgattgcacaccttccagtgtgcttcccatcgaaccgcatactgacgaattcatgtccaattcaggtcaccttcgagggcaccactacctgggagtacgaggagtgggatggacccctcctgtacatctccggcaaggacatcaccgtcacccagtcttccggagcggtcctcgacggcaacggtgccaagtggtgggacggcgagggcaccaacggcggcaagaccaagcccaagttcttctacgcccactccctggacaactcggtcatcaagggcctgcagatcaagaacacccccgtccaggccatctccgtcgagtcggactaccttaccatcgaggacgtgaccatcgacaacagcgacggtgacgacaacggcggtcacaacaccgacggtttcgacatcagcgagagtacctacatcaccatcaccggtgccaccgtcaagaaccaggacgactgtgtcgctatcaactcgggcgaggtatgtgtttcccacagatggcgttggaaaaaggacctcaagccgcaacaacctcggaccgaccaattgatcgctggtattaatccttttctcctcgcagaacatctacttctccggtggtacttgctccggcggccacggtctctccatcggctccgtcggcggccgcgacgacaacaccgtcaagaacgtcaccttcatcgactcgaccgtcaccgactccgagaacggtgtccgcatcaagaccgtctacgacgccaccggtgaggtcgaggacatcaccttctccaacatcaagatctccgacatcaccgactatggtatcgtcatcgagcaggactacgagaacggcagccccaccggtacccccaccgacggcgtcaagatctccggcgtcaagatggagaaggtcaccggtagcgtcgagagcgatgccaccgagatctacatcctctgcggcgacggcagctgcactgacttcacctggagcggcgtcgatgtcaccggtggaaagaccagcagcaagtgcgagaacttgccctccggtgtgtcttgctag

SEQ ID NO: 38 - protein, 369 aa, Aspergillus aculeatus
MPSIQSSLLCAATLATALVSAAPATRASDFAKRSTCTFTSAAQASESKTSCTDIVLKDITVPAGETLNLKDLKSGTTVTFEGTTTWEYEEWDGPLLYISGKDITVTQSSGAVLDGNGAKWWDGEGTNGGKTKPKFFYAHSLDNSVIKGLQIKNTPVQAISVESDYLTIEDVTIDNSDGDDNGGHNTDGFDISESTYITITGATVKNQDDCVAINSGENIYFSGGTCSGGHGLSIGSVGGRDDNTVKNVTFIDSTVTDSENGVRIKTVYDATGEVEDITFSNIKISDITDYGIVIEQDYENGSPTGTPTDGVKISGVKMEKVTGSVESDATEIYILCGDGSCTDFTWSGVDVTGGKTSSKCENLPSGVSC

SEQ ID NO: 39 - protein, 347 aa, Aspergillus aculeatus
PATRASDFAKRSTCTFTSAAQASESKTSCTDIVLKDITVPAGETLNLKDLKSGTTVTFEGTTTWEYEEWDGPLLYISGKDITVTQSSGAVLDGNGAKWWDGEGTNGGKTKPKFFYAHSLDNSVIKGLQIKNTPVQAISVESDYLTIEDVTIDNSDGDDNGGHNTDGFDISESTYITITGATVKNQDDCVAINSGENIYFSGGTCSGGHGLSIGSVGGRDDNTVKNVTFIDSTVTDSENGVRIKTVYDATGEVEDITFSNIKISDITDYGIVIEQDYENGSPTGTPTDGVKISGVKMEKVTGSVESDATEIYILCGDGSCTDFTWSGVDVTGGKTSSKCENLPSGVSC

SEQ ID NO: 40 - DNA, 1158 bp, Aspergillus aculeatus
  sig_peptide (1)..(63)
  exon (1)..(630)
  Intron (631)..(699)
  exon (700)..(1158)
atgccttccttctcttctcttgtggcctacagcctggctgctggggctactcttgtgtccgcttcccccatagaggctcgcggcagttgcactttcaccaccgctgctgctgcgaaggcgggtaaggccagctgctcgaccattgtcctcgacaacattgctgttcctgccggaaccacgctggacttgaccggcctcaagagcggcactcatgtcaccttcgagggcaccaccacttttggctatgaggaatgggcgggtcccttgatctcaatgagtggcacggacatcaccgttaccggagcctccggtcatctcatcaactgcgatggctcccgctggtgggatggtaagggaacgagcggaaagaccaagcccaagttcttctacgcccacgggctggactcctcctccatcactggactcgagatcaagaatacccctctcatggccttcagtatcgaggcaaacgatatcaccctcaccgatattaccatcaacaacgctgatggcgacagccttggtggccacaacaccgacgcattcgacgtgggcaactcggttggcgtgaacatcgtcaagccctgggttcacaaccaggacgactgtctcgcaatcaactccggcgaagtatatcagcctctttctccggccccctatctgatcaaggcagtcactaatccatggtctactgcttagaatatctacttcaccggcggaacttgcatcggcggccacggcctctctatcggctccgtgggtggccgttccgacaacaccgtcaagaacgtcacgatcgagcactccaccgtgtccaactctgagaatgccgtccgcatcaagaccatctccggcgccacgggctctgtttccgacgtcaaatacacgaacattatcatgtccggtatcaccgactacggagtggtcatccagcaggactatgaggatggcaagcccaccggtaagcctaccaacggtgtgtcggtcacggatatcacactggatggcgtgaccggtagtgttgcgagcggtgccacggaggtctacctcctgtgtggcagcggtagctgcaaggattggacctggactgatgtcaaggttactggcggcaagaagtccagtgcttgcaagaactatccctctgttgcgtcttgttaa

SEQ ID NO: 41 - protein, 362 aa, Aspergillus aculeatus
MPSFSSLVAYSLAAGATLVSASPIEARGSCTFTTAAAAKAGKASCSTIVLDNIAVPAGTTLDLTGLKSGTHVTFEGTTTFGYEEWAGPLISMSGTDITVTGASGHLINCDGSRWWDGKGTSGKTKPKFFYAHGLDSSSITGLEIKNTPLMAFSIEANDITLTDITINNADGDSLGGHNTDAFDVGNSVGVNIVKPWVHNQDDCLAINSGENIYFTGGTCIGGHGLSIGSVGGRSDNTVKNVTIEHSTVSNSENAVRIKTISGATGSVSDVKYTNIIMSGITDYGVVIQQDYEDGKPTGKPTNGVSVTDITLDGVTGSVASGATEVYLLCGSGSCKDWTWTDVKVTGGKKSSACKNYPSVASC

SEQ ID NO: 42 - protein, 340 aa, Aspergillus aculeatus
PIEARGSCTFTTAAAAKAGKASCSTIVLDNIAVPAGTTLDLTGLKSGTHVTFEGTTTFGYEEWAGPLISMSGTDITVTGASGHLINCDGSRWWDGKGTSGKTKPKFFYAHGLDSSSITGLEIKNTPLMAFSIEANDITLTDITINNADGDSLGGHNTDAFDVGNSVGVNIVKPWVHNQDDCLAINSGENIYFTGGTCIGGHGLSIGSVGGRSDNTVKNVTIEHSTVSNSENAVRIKTISGATGSVSDVKYTNIIMSGITDYGVVIQQDYEDGKPTGKPTNGVSVTDITLDGVTGSVASGATEVYLLCGSGSCKDWTWTDVKVTGGKKSSACKNYPSVASC

SEQ ID NO: 43 - DNA, 1208 bp, Aspergillus aculeatus
  sig_peptide (1)..(51)
  exon (1)..(228)
  Intron (229)..(279)
  exon (280)..(699)
  Intron (700)..(749)
  exon (750)..(1208)
atgcgtttcgatctcctcaccctggccgctctcggctccctcgccgttgcggcccctgccccccacgatgttgctgagagagatctcgtcgagagatcctcctgcaccttcaccgatgctgcctccgccaaggccggtgtcaagaagtgctccagctcgatcctcaagaacatcaaggtccccgccggccagacccttgatctgtccggtgccaagaagggctccaccgtatgttcctccactccaatgtgccagccccctttactgactgtgtgaaaggtcaccttcgagggcaccaccaccttcggctacaaggagtggaagggccccctcatccgcctcggcggtgagggcgtcactttcactgctgcctcgggcgccgtgatcgacgcccagggtgagcgctggtgggacagcaagggcacgaacggcggcaagaccaagcccaagttcatgtacgcgcacaagctgcagagctcgtacgtcaagaacctgcacatcaagaacacgccggtgcaggcgatttcggtgcagggcaacgacgtgcacatcgagggcgtgaccatcgacaactcggccggcgacagcaagggcggccacaacaccgacgccttcgacatcagcgagtccaacggcgtctacatcagcggcgccaaggtctacaaccaggacgactgcctggccatcaactccggcgaggtgggcccccctttcgtttattctttggaaaaaaaaactaacgacaccagaacatctacttcgacagcggctactgctccggcggccacggcctgtcgatcggctccgtcggcggccgcgacaacaacgtcgtcaagggcgtgcacatcaccaacagccacgtcgtcaactccgacaacggcgtccgcatcaagaccatctacaagaagaccggctccgtcaccgacatcacctacgacaacatccagctcgagaacattgccaagtacggcatcgtcatcgagcaggactacgagaacggttctcctaccggcaccccctccaacagcatccccattaaggatgtcaccatcaacaaggtcaccggctccgtcaagagctccgcccagcctgtctacatcctgtgcggttccggctcctgcgctgactggacctggaagggcgttgatatctccggtggtaaggacaagaagtcttgcaagaacgtccccagcggcgcttcttgctag

SEQ ID NO: 44 - protein, 368 aa, Aspergillus aculeatus
MRFDLLTLAALGSLAVAAPAPHDVAERDLVERSSCTFTDAASAKAGVKKCSSSILKNIKVPAGQTLDLSGAKKGSTVTFEGTTTFGYKEWKGPLIRLGGEGVTFTAASGAVIDAQGERWWDSKGTNGGKTKPKFMYAHKLQSSYVKNLHIKNTPVQAISVQGNDVHIEGVTIDNSAGDSKGGHNTDAFDISESNGVYISGAKVYNQDDCLAINSGENIYFDSGYCSGGHGLSIGSVGGRDNNVVKGVHITNSHVVNSDNGVRIKTIYKKTGSVTDITYDNIQLENIAKYGIVIEQDYENGSPTGTPSNSIPIKDVTINKVTGSVKSSAQPVYILCGSGSCADWTWKGVDISGGKDKKSCKNVPSGASC

SEQ ID NO: 45 - protein, 368 aa, Aspergillus aculeatus; identical to SEQ ID NO: 44

SEQ ID NO: 46 - DNA, 1504 bp, Talaromyces leycettanus
  sig_peptide (1)..(72)
  exon (1)..(282)
  Intron (283)..(349)
  exon (350)..(716)
  Intron (717)..(775)
  exon (776)..(975)
  Intron (976)..(1063)
  exon (1064)..(1504)
atgccattcaagaactccctcttctctgcgtctctgccactttggctggcattgtcctccctcagtaacgccgatccaggtccatttgacgatggacccaatgtctgcacagtcaaagccaatggacatcagaaggacgatgtgccgaatatcctcagggccttcgaaaggtgtggcaatggaggcacgattgtgttccctgagaatgagagttactggatcgcatcgcgactcaatccggtcatcaataatgtagccatcgaatggagagggaaatggacggtgagaacgctttctccctcagagcaacgaaactctgcaaatctcgttcctaacaagaacgcattagttctctgatgacttaaactactggcgcaacaactcctaccccatcgccttccagaaccaccacgctggcttcgtcatcacaggaaacaacatcaccattgacggttacggcaccggcggcatcgatggcaacggcaacgcatggtataacgctgaggaaggcaacactcaacctggcagacccatgccgtttgtgttctggaacgtttcagacgtcaatgtcgagaacttctacgtcaaggaccctccgctgtggagcctgaacattatgaacggaaccaatatgcgcttcaacaatatcaactgcaacgctactgctgtgaatgcgccgtatgggacgaactgggtgcagaatacagatggttttggtgagtacttctgaacagaaaggatggattccgatatttgggctaattcgatgcattagatactatggatgtcaacaacgtacagcttaccaacttcgtgtaccaaggcggagacgactgcatcgccatcaagcctcgatcctacaacgtcgatatccgcaacgtgacttgcgtcggtggaaacggcatcgccattggaagtcttggtcaatatctcgaggactcgagcgtggagaacgtcatcgtggacaatgtaaaggtaataatccagttttcccccttcccttttctctttcttcatgcccttctacccaggatcactaacctctcgatgcccttcaatccagatcatccgccacaacgaagacatgcacaactccgcatacatcaaaacctgggtcggagccctcgtcccgcaaagctcctatgaaagcgccggtctcccccgaggtgctggctggggcagtgtgcgaaatatcctgttttcgaactttgacgttcagggcgccaatgccggacccgcgatcagcgaggacagcggaaacaatggctcatattccggaacaagtctaatggagatttcgaacattgcttttgtgaactttacgggctggatcgatacgaccaagaacactacctcgacgatctcgtgctcgaatgttcatccgtgctacaacattgcgtttgagaacgtggtgctgtatgcgggccagaactcaacgacgcctgggaaggggtcctgtaaatatactgcggctggcggtgtgcatgggcttgatggatgttag

SEQ ID NO: 47 - protein, 429 aa, Talaromyces leycettanus
MPFKNSLFSASLPLWLALSSLSNADPGPFDDGPNVCTVKANGHQKDDVPNILRAFERCGNGGTIVFPENESYWIASRLNPVINNVAIEWRGKWTFSDDLNYWRNNSYPIAFQNHHAGFVITGNNITIDGYGTGGIDGNGNAWYNAEEGNTQPGRPMPFVFWNVSDVNVENFYVKDPPLWSLNIMNGTNMRFNNINCNATAVNAPYGTNWVQNTDGFDTMDVNNVQLTNFVYQGGDDCIAIKPRSYNVDIRNVTCVGGNGIAIGSLGQYLEDSSVENVIVDNVKIIRHNEDMHNSAYIKTWVGALVPQSSYESAGLPRGAGWGSVRNILFSNFDVQGANAGPAISEDSGNNGSYSGTSLMEISNIAFVNFTGWIDTTKNTTSTISCSNVHPCYNIAFENVVLYAGQNSTTPGKGSCKYTAAGGVHGLDGC

SEQ ID NO: 48 - protein, 404 aa, Talaromyces leycettanus
PGPFDDGPNVCTVKANGHQKDDVPNILRAFERCGNGGTIVFPENESYWIASRLNPVINNVAIEWRGKWTFSDDLNYWRNNSYPIAFQNHHAGFVITGNNITIDGYGTGGIDGNGNAWYNAEEGNTQPGRPMPFVFWNVSDVNVENFYVKDPPLWSLNIMNGTNMRFNNINCNATAVNAPYGTNWVQNTDGFDTMDVNNVQLTNFVYQGGDDCIAIKPRSYNVDIRNVTCVGGNGIAIGSLGQYLEDSSVENVIVDNVKIIRHNEDMHNSAYIKTWVGALVPQSSYESAGLPRGAGWGSVRNILFSNFDVQGANAGPAISEDSGNNGSYSGTSLMEISNIAFVNFTGWIDTTKNTTSTISCSNVHPCYNIAFENVVLYAGQNSTTPGKGSCKYTAAGGVHGLDGC

SEQ ID NO: 49 - DNA, 1517 bp, Aspergillus aculeatus
  sig_peptide (1)..(54)
  exon (1)..(624)
  Intron (625)..(688)
  exon (689)..(727)
  Intron (728)..(791)
  exon (792)..(993)
  Intron (994)..(1059)
  exon (1060)..(1517)
atgcgtgctcttttccttcttgcgctgggttctatcccggcgctcgtcagcggtcaactctctggcagtgttggccccttgacctctgcttccaccaaaggtgcgacaaaaacatgcaatatcctcagctacggcgcagtggccgacaactcgaccgatgttgggcctgccattacatcggcctgggctgcatgcaagagcggaggtcttgtctacatcccatctggcaactatgccttaaacacctgggtcaccctgactggaggcagtgcgaccgcaatccagctggatggtatcatttatcgcacaggtaccgccagtgggaacatgattgcagtcactgacaccaccgacttcgagctgttcagtagcacctccaaaggtgctgtgcagggattcggctatgtgtaccatgcggagggaacctacggagcacggattctgcgcttgactgatgtgacccatttctctgtgcatgatgtgatcttggtggatgcgcctgctttccactttaccatggatacctgctccgatggggaggtgtacaacatggcgattcgtggtggcaatgagggcggcttggacgggattgatgtctggggaagcaacatctgggttcacgatgtaagtcacgcccgagtggcaatatgctacttctctgtcgctcacgagatgtgcactcatttaggttgaagtgaccaacaaggatgaatgtgtaacagtcaaggtaaggctttcccttgcaagcacgaattgacgcgctcgagccttgattgacagacggaccgcagagcccggccaacaatattctggtggagagcatctattgcaactggagtggtggttgcgcaatggggtcgctcggggccgacaccgacgtcaccgatattgtctaccgcaatgtttacacctggtcatcgaaccagatgtacatgatcaagagcaatggcggtagtggaacggtgtcgaatgttttgctggaaaatttcatcggtcagtgctgctgcctatgcccccacctttctggcttgaaactgttaactgatcccctttatttagggcacggtaatgcgtactcgctcgacatcgacggctactggagcagcatgactgcggtggccggggacggggtgcagctgaacaacatcacggtgaagaactggaagggcaccgaggcgaacggagcgacccgaccaccgatccgagtggtgtgtagtgacacggcgccttgcacggacttgacgctggaagacattgccatctggaccgaaagcggctcgagtgaactgtacctgtgccgttccgcttacggatcgggatactgtttgaaggacagctcttcgcacacatcctacaccacaaccagcactgtcacggcggctccctcaggatattcggcgacaaccatggcagccgacttggcaaccgcatttggtctcactgcttccattcccattccgaccatcccgacctcgttttatcccgggttgaccccgtacagtgccttggcaggctag

SEQ ID NO: 50 - protein, 440 aa, Aspergillus aculeatus
MRALFLLALGSIPALVSGQLSGSVGPLTSASTKGATKTCNILSYGAVADNSTDVGPAITSAWAACKSGGLVYIPSGNYALNTWVTLTGGSATAIQLDGIIYRTGTASGNMIAVTDTTDFELFSSTSKGAVQGFGYVYHAEGTYGARILRLTDVTHFSVHDVILVDAPAFHFTMDTCSDGEVYNMAIRGGNEGGLDGIDVWGSNIWVHDVEVTNKDECVTVKSPANNILVESIYCNWSGGCAMGSLGADTDVTDIVYRNVYTWSSNQMYMIKSNGGSGTVSNVLLENFIGHGNAYSLDIDGYWSSMTAVAGDGVQLNNITVKNWKGTEANGATRPPIRVVCSDTAPCTDLTLEDIAIWTESGSSELYLCRSAYGSGYCLKDSSSHTSYTTTSTVTAAPSGYSATTMAADLATAFGLTASIPIPTIPTSFYPGLTPYSALAG

SEQ ID NO: 51 - protein, 421 aa, Aspergillus aculeatus
LSGSVGPLTSASTKGATKTCNILSYGAVADNSTDVGPAITSAWAACKSGGLVYIPSGNYALNTWVTLTGGSATAIQLDGIIYRTGTASGNMIAVTDTTDFELFSSTSKGAVQGFGYVYHAEGTYGARILRLTDVTHFSVHDVILVDAPAFHFTMDTCSDGEVYNMAIRGGNEGGLDGIDVWGSNIWVHDVEVTNKDECVTVKSPANNILVESIYCNWSGGCAMGSLGADTDVTDIVYRNVYTWSSNQMYMIKSNGGSGTVSNVLLENFIGHGNAYSLDIDGYWSSMTAVAGDGVQLNNITVKNWKGTEANGATRPPIRVVCSDTAPCTDLTLEDIAIWTESGSSELYLCRSAYGSGYCLKDSSSHTSYTTTSTVTAAPSGYSATTMAADLATAFGLTASIPIPTIPTSFYPGLTPYSALAG

SEQ ID NO: 52 - DNA, 1428 bp, Talaromyces calidicanius
  sig_peptide (1)..(66)
  CDS (1)..(1428)
atgaaagcccctattttatcattgtgtgccacggcaacacttgctctcgcaaccagtgcttgcgctggacattgcaagggcttggagcctattccaacttatactagttttcccacggcatgcaactcagcttcccaggtcaccattacctattcacctccggaaggatacacatttggaggtggcagtcctacagcaaagagcacgcaaactcggacatctgcggcatccgagtgcattgtgaccccgcttggctgggatcgagatgactccggacaaatcatggctgcagtcgaaaagtgcggaacagatggtacgatcacattgccggcgccatatgtttacactatcagccaaagactctatatgaagctagttcgggctcgcttgaatattttcggaactctctccttcactccggatcttggttactggattgacaattctcatcgcatcgaatttcagaatcaaagcaccgcatggattgtcgagggtgaagactttgtcatctctggtggtggttgggagcagggaggcatcaacggaaatggacaaccttggtatggcagagcagctggccatagtaaccagttcggaaggccgattcctcttactatctggaacagtcagaatgcaacggtagaggacttttccatccgacagcctcaattctggtctttctatattcaggactcttacgatatcaaacttactggcatttacattaatggcaccaataccgatccggctggtaattcttccaactatgagaccaacgtcgacggcttcgattcaatccgtgtggatggcttggaagtcacagattgggtcttccatggtggcgacgattgctctgcacctaagggtaactctaccaacatggtattccgcaacatgacctgtgtaggtggtggtatagccttcggaagtgttggccagtacccggatatgcctgactacatcaccaacgtgacggcatccaatattaccgtcaagcagctcatctcgccaaaatatggaggagcaactgtcagtggcgcagcatacttcaaatcttgggttggagtttctgagggccagcctcctcaaggaggaggtggtggtaccgggcgagtgtggaacgtgactttctccgaaatcaaggtcgaaaacatcactcagggaatctacgtcaacaaatgttattacaaagtagctgatcaggctaactactgtgatacctcgacttttgagttcgaggacttgtccttttcgaactttactggcactgttcgatcggcttatggtgtctctttgaactgctctgctactgcaccttgtcagaatgtacaatttagtaacgtggactttacagctgcaaatggcagcactgccggtgtgtattgcgacaacgccgaaggggtctcaggagttcaatgttcgaactag

SEQ ID NO: 53 - protein, 475 aa, Talaromyces calidicanius
MKAPILSLCATATLALATSACAGHCKGLEPIPTYTSFPTACNSASQVTITYSPPEGYTFGGGSPTAKSTQTRTSAASECIVTPLGWDRDDSGQIMAAVEKCGTDGTITLPAPYVYTISQRLYMKLVRARLNIFGTLSFTPDLGYWIDNSHRIEFQNQSTAWIVEGEDFVISGGGWEQGGINGNGQPWYGRAAGHSNQFGRPIPLTIWNSQNATVEDFSIRQPQFWSFYIQDSYDIKLTGIYINGTNTDPAGNSSNYETNVDGFDSIRVDGLEVTDWVFHGGDDCSAPKGNSTNMVFRNMTCVGGGIAFGSVGQYPDMPDYITNVTASNITVKQLISPKYGGATVSGAAYFKSWVGVSEGQPPQGGGGGTGRVWNVTFSEIKVENITQGIYVNKCYYKVADQANYCDTSTFEFEDLSFSNFTGTVRSAYGVSLNCSATAPCQNVQFSNVDFTAANGSTAGVYCDNAEGVSGVQCSN

SEQ ID NO: 54 - protein, 452 aa, Talaromyces calidicanius
HCKGLEPIPTYTSFPTACNSASQVTITYSPPEGYTFGGGSPTAKSTQTRTSAASECIVTPLGWDRDDSGQIMAAVEKCGTDGTITLPAPYVYTISQRLYMKLVRARLNIFGTLSFTPDLGYWIDNSHRIEFQNQSTAWIVEGEDFVISGGGWEQGGINGNGQPWYGRAAGHSNQFGRPIPLTIWNSQNATVEDFSIRQPQFWSFYIQDSYDIKLTGIYINGTNTDPAGNSSNYETNVDGFDSIRVDGLEVTDWVFHGGDDCSAPKGNSTNMVFRNMTCVGGGIAFGSVGQYPDMPDYITNVTASNITVKQLISPKYGGATVSGAAYFKSWVGVSEGQPPQGGGGGTGRVWNVTFSEIKVENITQGIYVNKCYYKVADQANYCDTSTFEFEDLSFSNFTGTVRSAYGVSLNCSATAPCQNVQFSNVDFTAANGSTAGVYCDNAEGVSGVQCSN

SEQ ID NO: 55 - DNA, 1410 bp, Penicillium sp. XZ2495
  sig_peptide (1)..(48)
  CDS (1)..(1410)
atgaagtctattctgagtgtagccgtctgggcttgcgccgttgcagctcgcgcacctgattggaatccgaatcctcacaagccaactcccgtcgtgacttactctcatttccccacgactgctagtgcttctcagatgacactcacgtactcgaccccatccggatatgtctttggaagcaaaaccactccggctagtatacctacaaaagccccaactgagtgcatcgtgacaccgcttggatggggccaagatgactcgggacagatcatggccgccgtggaagagtgtggaacggatggaatcatcacgctgccagctccatatgtgtacacaatcagccagcgattgtacatgaatctcgttcgcgctcggttgaatatcttcggtactctctctttcgagccgaacctcggatactggatcgacaattcgcatcgcgtcgaatttcagaaccaaagcacagcctggattgtcgagggcagtgactttgtcatctccggtggcggctggcaacagggcggaatcaatggcaacggacagccatggtatggtagggccgccggccagagcaaccagtatggtcgccccatttcactcacaatctggcaaggaaacaacgtcaccattgaagatttctccatccgccagcctcagttctggtctttctacatccaggattcgcaagacgtgaaactaaccaacatctacatcaacggaaccaacacggacccggccggtaactcatccaactacgaaacaaacgttgatggcttcgactctatccgagttaatggcctcgagacatcaaactggctgttccatggcggtgacgactgtcacgcacccaagggtaattctaccaacatggtcttccacaacataacctgtatcggtggtgggattgcctttggcagcattggccagtacgaaaccatgcccgactacatgacaaatgtgactgcaacaaacatcagcgtaacccaggaaatctcccctctgtatggtggagcaactgtgaacggtgcggcatacttcaaatcctgggtgggtgtcgacgaaggctcacccccgcaaggcggtggtggcggtactggacgcgtgtggaatatcagcttttcggatctggaagcgcacaatacgactcaggcggtgtatatcaacaaatgctactacaaggttgcagatcaagctaattactgtgatacgtcgacacttgagtttgagaatatgaccttcaccgacgtcaagggtcaggtgaattccaaatacggtatctcgctgaactgttcggcagatgctccatgccagaatatgaattttgtggatatagatctgacactggctaatggcacggcggccggcgactactgtgataacgtgcagagctcaacaggtatcacatgttga

SEQ ID NO: 56 - protein, 469 aa, Penicillium sp. XZ2495
MKSILSVAVWACAVAARAPDWNPNPHKPTPVVTYSHFPTTASASQMTLTYSTPSGYVFGSKTTPASIPTKAPTECIVTPLGWGQDDSGQIMAAVEECGTDGIITLPAPYVYTISQRLYMNLVRARLNIFGTLSFEPNLGYWIDNSHRVEFQNQSTAWIVEGSDFVISGGGWQQGGINGNGQPWYGRAAGQSNQYGRPISLTIWQGNNVTIEDFSIRQPQFWSFYIQDSQDVKLTNIYINGTNTDPAGNSSNYETNVDGFDSIRVNGLETSNWLFHGGDDCHAPKGNSTNMVFHNITCIGGGIAFGSIGQYETMPDYMTNVTATNISVTQEISPLYGGATVNGAAYFKSWVGVDEGSPPQGGGGGTGRVWNISFSDLEAHNTTQAVYINKCYYKVADQANYCDTSTLEFENMTFTDVKGQVNSKYGISLNCSADAPCQNMNFVDIDLTLANGTAAGDYCDNVQSSTGITC

SEQ ID NO: 57 - protein, 452 aa, Penicillium sp. XZ2495
APDWNPNPHKPTPVVTYSHFPTTASASQMTLTYSTPSGYVFGSKTTPASIPTKAPTECIVTPLGWGQDDSGQIMAAVEECGTDGIITLPAPYVYTISQRLYMNLVRARLNIFGTLSFEPNLGYWIDNSHRVEFQNQSTAWIVEGSDFVISGGGWQQGGINGNGQPWYGRAAGQSNQYGRPISLTIWQGNNVTIEDFSIRQPQFWSFYIQDSQDVKLTNIYINGTNTDPAGNSSNYETNVDGFDSIRVNGLETSNWLFHGGDDCHAPKGNSTNMVFHNITCIGGGIAFGSIGQYETMPDYMTNVTATNISVTQEISPLYGGATVNGAAYFKSWVGVDEGSPPQGGGGGTGRVWNISFSDLEAHNTTQAVYINKCYYKVADQANYCDTSTLEFENMTFTDVKGQVNSKYGISLNCSADAPCQNMNFVDIDLTLANGTAAGDYCDNVQSSTGITC

SEQ ID NO: 58 - DNA, 1416 bp, Penicillium sp-54788
  sig_peptide (1)..(45)
  exon (1)..(1134)
  Intron (1135)..(1185)
  exon (1186)..(1416)
atgagagcctttgctctatatgtactggcagcggctgctgcagggctgaaaaaggatgaccccctagcccaggtctcatcctatcatccggactttgcaaccatcactgtctccgtcccccaaatgacacttcctctgactgccgcatccgactacacgcttggtggaactatacccactcgtgcggctcaggctcactggccgaaacggctcatctgcaccgtcatcccccatggctggggccaggatgacgcgcctcagatcctcgctgcagtcgaagcatgcggcaccgacggagaagtcacgctacctgccccgcacgtatataccattgccagtcggatgtatatgcatctacagcgcgccaagctcaacatctttggcacactgtccttcactcccgatctcgggtactggattgacaattcccaccgcatcgagttccagaaccagagtgcggcatggattgttgaaggggaggactatgtgatctccgggggtggatgggctcaaggcggcgtcgacggtaacgggcagccctggtacggccatgctgcgggccagagcaaccaattcgggcgccctattccactggcaatctacaacagtaccaatgtaactgtggaagactttagtttccgtcagcctcagttctggactttctgggtacaggattcctatgatgtggctctgacgggcatctatatcaacggcaccaataccgatccctacggcaacggttccaactgggaaaccaatattgatggcattgacacgatgcgtgtcaatggcctcactatggcagactgggttttccacggcggcgatgactgttttgcgccaaagggaaattcgacgaatatggtcttgcgcaatattacctgtgtcggcggcggtatcgctttcggcagcatcggtcaatacccagagtcgccggactatattgccaacgtcactgctactgatatctcagtcagccagtccgttagcccgagatatggcgggggcctcgtcaagggtggtacgtatttcaagtcctgggtcggggtggaaatgggcgtgcctccccagggaggtggtggaggcaccggccgcgtatggaacgtgacgtttgatgggttggcagtgcataacgttagtcagggggtgtatataaacaaatgttattacaaggtggctgaccaggcaaactactgtgacacttcaactctggagttcgaggagttgacatttcgaaacgtttcaggaatcgtgtcgtcgcagtatggcgttgccttcaactgctcgaaggctgcaccctgtcatgatcttgcggtctacgacttaaatctaacgctggcgagcggagaacagactggggtgtattgtgataacgtggatggtttaacgggtgctaattgtgcggtggagaattag

SEQ ID NO: 59 - protein, 454 aa, Penicillium sp-54788
MRAFALYVLAAAAAGLKKDDPLAQVSSYHPDFATITVSVPQMTLPLTAASDYTLGGTIPTRAAQAHWPKRLICTVIPHGWGQDDAPQILAAVEACGTDGEVTLPAPHVYTIASRMYMHLQRAKLNIFGTLSFTPDLGYWIDNSHRIEFQNQSAAWIVEGEDYVISGGGWAQGGVDGNGQPWYGHAAGQSNQFGRPIPLAIYNSTNVTVEDFSFRQPQFWTFWVQDSYDVALTGIYINGTNTDPYGNGSNWETNIDGIDTMRVNGLTMADWVFHGGDDCFAPKGNSTNMVLRNITCVGGGIAFGSIGQYPESPDYIANVTATDISVSQSVSPRYGGGLVKGGTYFKSWVGVEMGVPPQGGGGGTGRVWNVTFDGLAVHNANYCDTSTLEFEELTFRNVSGIVSSQYGVAFNCSKAAPCHDLAVYDLNLTLASGEQTGVYCDNVDGLTGANCAVEN

SEQ ID NO: 60 - protein, 438 aa, Penicillium sp-54788
KKDDPLAQVSSYHPDFATITVSVPQMTLPLTAASDYTLGGTIPTRAAQAHWPKRLICTVIPHGWGQDDAPQILAAVEACGTDGEVTLPAPHVYTIASRMYMHLQRAKLNIFGTLSFTPDLGYWIDNSHRIEFQNQSAAWIVEGEDYVISGGGWAQGGVDGNGQPWYGHAAGQSNQFGRPIPLAIYNSTNVTVEDFSFRQPQFWTFWVQDSYDVALTGIYINGTNTDPYGNGSNWETNIDGIDTMRVNGLTMADWVFHGGDDCFAPKGNSTNMVLRNITCVGGGIAFGSIGQYPESPDYIANVTATDISVSQSVSPRYGGGLVKGGTYFKSWVGVEMGVPPQGGGGGTGRVWNVTFDGLAVHNANYCDTSTLEFEELTFRNVSGIVSSQYGVAFNCSKAAPCHDLAVYDLNLTLASGEQTGVYCDNVDGLTGANCAVEN

SEQ ID NO: 61 - DNA, 1437 bp, Aspergillus luchuensis
  sig_peptide (1)..(60)
  exon (1)..(264)
  Intron (265)..(318)
  exon (319)..(685)
  Intron (686)..(745)
  exon (746)..(945)
  Intron (946)..(996)
  exon (997)..(1437)
atgcaactagcagcttcggtttcgctcttgctcctggggctggcctccgttggccacgcaggaaatgtggaaaacaaccacaatgtctgcaccgtgcgagcaaacgggggccatcaagacgacgtccccaatattatggcggcgttcgaagagtgtggcaatggaggtaccatcattttccccgaagaccaatcctactggattgcgacaagactgcatccaacattgaaggatgtggcaattgaatggcggggaaagtggacagtaagactccctcaccatccatctcgtgacctgtgaaacactgattcggtccagttttccgacaatctcacctactggcgtaacaactcctacccaattgcgttccaaaaccaccatgcgggcttcattattagcggcgacaacatcaccatcaatggctatggcaccggcggcatcgacggcaatggaaatacttggtacacagctgagaagggcgacacacagccggggcgtccgatgccctttgtcttctggaacgtgtctgaagtggttgttgacagcttctacgttaaggatccgcctttatggagtatcaacatcatgaacgggactaatatgcgcttcaacaacatctactgcaatgccacggctgtggatgccccgtggggtgacaattgggtgcagaatacggatggtttcggtatgtttttccatccttatcagtgacttgtactaggactgactagtatctcgtattcagatactatggacgctgtcaacatccagctcaccaactttgtttaccaaggtggagatgactgcatcgctatcaagcctcgctcctataatatcgatattcagaacgtcacctgccgtggtggcaacggcattgcgattggcagcttgggtcaatacctggaagatagtagcgtagctaacattcgtgtggacaaggtcaatgtacgtgatgttttcccggccaccatcatcagtagtactaacggtgatcagatcatccgatacaacgaagacatgcacaacagcgcctacctcaaaacctgggtcggagccctcgtcccccaaagttcctacgaaagcgctggtgtgcctcgtggcgatggctggggcagcattcgtaacgtcctcttttcaaacttcaatgtacagggagcgagcgctggcccttccatcagccaggacagtggagacaacggttcctacgcgggtacaagcaagatgtcgatctcaaatgttgcgtttgtcaatttcacgggatgggtggatactgataagtcagtggtctcgacggtctcgtgctcagaggtacatccgtgctataatatcgactacgacaacgtggtgctgtatccagggaagaatgccactacagctggaacggggtcatgtaaatatacggcggatggaggtgtacatggcttgagtggatgctga

SEQ ID NO: 62 - protein, 423 aa, Aspergillus luchuensis
MQLAASVSLLLLGLASVGHAGNVENNHNVCTVRANGGHQDDVPNIMAAFEECGNGGTIIFPEDQSYWIATRLHPTLKDVAIEWRGKWTFSDNLTYWRNNSYPIAFQNHHAGFIISGDNITINGYGTGGIDGNGNTWYTAEKGDTQPGRPMPFVFWNVSEVVVDSFYVKDPPLWSINIMNGTNMRFNNIYCNATAVDAPWGDNWVQNTDGFDTMDAVNIQLTNFVYQGGDDCIAIKPRSYNIDIQNVTCRGGNGIAIGSLGQYLEDSSVANIRVDKVNIIRYNEDMHNSAYLKTWVGALVPQSSYESAGVPRGDGWGSIRNVLFSNFNVQGASAGPSISQDSGDNGSYAGTSKMSISNVAFVNFTGWVDTDKSVVSTVSCSEVHPCYNIDYDNVVLYPGKNATTAGTGSCKYTADGGVHGLSGC

SEQ ID NO: 63 - protein, 402 aa, Aspergillus luchuensis
NVENNHNVCTVRANGGHQDDVPNIMAAFEECGNGGTIIFPEDQSYWIATRLHPTLKDVAIEWRGKWTFSDNLTYWRNNSYPIAFQNHHAGFIISGDNITINGYGTGGIDGNGNTWYTAEKGDTQPGRPMPFVFWNVSEVVVDSFYVKDPPLWSINIMNGTNMRFNNIYCNATAVDAPWGDNWVQNTDGFDTMDAVNIQLTNFVYQGGDDCIAIKPRSYNIDIQNVTCRGGNGIAIGSLGQYLEDSSVANIRVDKVNIIRYNEDMHNSAYLKTWVGALVPQSSYESAGVPRGDGWGSIRNVLFSNFNVQGASAGPSISQDSGDNGSYAGTSKMSISNVAFVNFTGWVDTDKSVVSTVSCSEVHPCYNIDYDNVVLYPGKNATTAGTGSCKYTADGGVHGLSGC

SEQ ID NO: 64 - DNA, 993 bp, Aspergillus niger
  sig_peptide (1)..(51)
  CDS (1)..(993)
atggttaagtcaattcttgcatccgttctctttgcagcgaccgcgctggccgcgagccgcatgacggctccttccggtgcgattgttgttgccaagtccggaggtgactacgacacgatcagcgctgccgttgatgctctcagcacgacttcgaccgagacccagaccatcttcattgaggagggatcctacgacgagcaggtgtatattcccgccctcagtggaaagctgattgtctacggtcagactgaggacactaccacctacaccagcaacctggtcaacatcacccacgccatcgctttggccgatgtcgacaatgacgatgagactgcaaccctccgtaactacgctgaaggctcggccatctacaacctcaacattgccaacacctgcggtcaggcctgccaccaggctctcgccgtgagcgcctatgccagcgagcagggatactacgcctgccagttcaccggataccaggacacccttctggctgagaccggctaccaggtttacgccggaacctacatcgagggtgccgtcgacttcatctttggacagcacgcccgcgcctggttccacgagtgcgacatccgcgtcctcgagggccccagctccgcctccatcaccgccaacggccgctcctccgagtcggacgactcttactacgtgatccacaagtccaccgtcgctgctgctgatggcaacgatgtttcctccggcacctactacctcggccgcccctggtcccagtacgctcgcgtctgcttccagaagacctccatgaccgatgtgatcaaccacctcggctggactgagtggtcgacctccacccccaacaccgagaacgtcacctttgttgaatacggcaacaccggcactggcgctgagggtccccgtgctaacttctcttctgagctgactgagcccatcactatctcttggcttctcggatctgactgggaggactgggttgataccagctacatcaac

SEQ ID NO: 65 - protein, 331 aa, Aspergillus niger
MVKSILASVLFAATALAASRMTAPSGAIVVAKSGGDYDTISAAVDALSTTSTETQTIFIEEGSYDEQVYIPALSGKLIVYGQTEDTTTYTSNLVNITHAIALADVDNDDETATLRNYAEGSAIYNLNIANTCGQACHQALAVSAYASEQGYYACQFTGYQDTLLAETGYQVYAGTYIEGAVDFIFGQHARAWFHECDIRVLEGPSSASITANGRSSESDDSYYVIHKSTVAAADGNDVSSGTYYLGRPWSQYARVCFQKTSMTDVINHLGWTEWSTSTPNTENVTFVEYGNTGTGAEGPRANFSSELTEPITISWLLGSDWEDWVDTSYIN

SEQ ID NO: 66 - protein, 313 aa, Aspergillus niger
SRMTAPSGAIVVAKSGGDYDTISAAVDALSTTSTETQTIFIEEGSYDEQVYIPALSGKLIVYGQTEDTTTYTSNLVNITHAIALADVDNDDETATLRNYAEGSAIYNLNIANTCGQACHQALAVSAYASEQGYYACQFTGYQDTLLAETGYQVYAGTYIEGAVDFIFGQHARAWFHECDIRVLEGPSSASITANGRSSESDDSYYVIHKSTVAAADGNDVSSGTYYLGRPWSQYARVCFQKTSMTDVINHLGWTEWSTSTPNTENVTFVEYGNTGTGAEGPRANFSSELTEPITISWLLGSDWEDWVDTSYIN

SEQ ID NO: 67 - DNA, 1250 bp, Aspergillus luchuensis
  sig_peptide (1)..(57)
  exon (1)..(645)
  Intron (646)..(695)
  exon (696)..(1250)
atgctcctccacggcctcctgctggccctccaggccatcctagcctcctcagcagccataacttctccatcctcaaaccatctctcaaccgccgctcgcgagaaatgccaaacaactctccaatgcccccccggcaccatcatcgtctccaacaccaacgcccaccctgacatctccaacttcaccaccctccaagcagccatcaacgccctccccaacgacaactcctcccaaaccatcctcctcctctccggctcctacaatgaacaagtcaacatcacccgcgccggccccatcaccctcctcggccagcaaccagaccgcgcagccctaaccgacccagcccgcaacaccgtcaacctcaccttcgccggcgccaacagcgacagcagcggcaacatcgacaacgtctggttcagcgtcatggtcgttgccccgaccctggacgccagtctcaccggctccgggacaacagggtacccagtaccagcagacaccccgttcgggaataccaacttccgcgtatacaacattgacttccgcaatacctacgcaccgtactctgctggtccagcgcacgctatcagctttagtcgctccaacggcggcttctactactgcggcttctactcttaccaggacacggtacatcccctcctcccccctacccccccagaaaactaacatattcacagatctacatcggcaaactcgggtcagcatacatgtacaaatccatcctcgcgggccaaaccgacttcctgtacggcttcggtacactcttcatccaatcctcccaaattatcctccgctcctgcggcggcggcatcacagcctggaagggcaccaacacgacggtccgcaacaactacggagtctacatccacgactccaccatcaacgccgcgaactcctccatcgcagagcaaatccaggggtcctgcgcgctaggcagaccttggaactcgctgcaccgatccatcttcgcgaacacatacgaggacgggagcatcgagccatcgggttacatcaattgggaggatcggtggagtaagaacgagacgttaatggcggagtatagggcctatggcccggggtttaatctcacaggcagggaggagagtgagatgagtgtattgttgagtagcagtgaagaggagaggtatagggatcccaagagggtgtttctatttgaggatgggagggaggggaatgtggcgtggattgattgggatgttgtatcctcttga

SEQ ID NO: 68 - protein, 399 aa, Aspergillus luchuensis
MLLHGLLLALQAILASSAAITSPSSNHLSTAAREKCQTTLQCPPGTIIVSNTNAHPDISNFTTLQAAINALPNDNSSQTILLLSGSYNEQVNITRAGPITLLGQQPDRAALTDPARNTVNLTFAGANSDSSGNIDNVWFSVMVVAPTLDASLTGSGTTGYPVPADTPFGNTNFRVYNIDFRNTYAPYSAGPAHAISFSRSNGGFYYCGFYSYQDTIYIGKLGSAYMYKSILAGQTDFLYGFGTLFIQSSQIILRSCGGGITAWKGTNTTVRNNYGVYIHDSTINAANSSIAEQIQGSCALGRPWNSLHRSIFANTYEDGSIEPSGYINWEDRWSKNETLMAEYRAYGPGFNLTGREESEMSVLLSSSEEERYRDPKRVFLFEDGREGNVAWIDWDVVSS

SEQ ID NO: 69 - protein, 379 aa, Aspergillus luchuensis
TSPSSNHLSTAAREKCQTTLQCPPGTIIVSNTNAHPDISNFTTLQAAINALPNDNSSQTILLLSGSYNEQVNITRAGPITLLGQQPDRAALTDPARNTVNLTFAGANSDSSGNIDNVWFSVMVVAPTLDASLTGSGTTGYPVPADTPFGNTNFRVYNIDFRNTYAPYSAGPAHAISFSRSNGGFYYCGFYSYQDTIYIGKLGSAYMYKSILAGQTDFLYGFGTLFIQSSQIILRSCGGGITAWKGTNTTVRNNYGVYIHDSTINAANSSIAEQIQGSCALGRPWNSLHRSIFANTYEDGSIEPSGYINWEDRWSKNETLMAEYRAYGPGFNLTGREESEMSVLLSSSEEERYRDPKRVFLFEDGREGNVAWIDWDVVSS

SEQ ID NO: 70 - DNA, 1247 bp, Aspergillus aculeatus
  sig_peptide (1)..(54)
  exon (1)..(633)
  Intron (634)..(689)
  exon (690)..(1247)
atgcttctctatcgtggtcttctgcttcttctgcacgttctgcttgtgcactcggctgctctccagccgcgtctctcgacagctactcgggagacatgccagacgagtctgaaatgccctgagggcacgatcatcgtgtccaactcgtcacaccccgccgctcaattcaagtctatccaggctgcgtttgcctccctccccaatgacaactcctcccacacaattctggtgcttgcaggaacctaccatgagcaactcaacctgacgcgcccgggccctgtcactttgctcggccagcaacccgatcgcagcgctctcaccgatcccactcgcaaccgcgtcaccatcacctgggctgctgccaaccaggacaataccggccagtcggtggacaacgtctactccagcgtattgatcgtctcgcctaccttggacgccagtctgactgggtcgggtaccacggggtttgctgttcctgcggacacaccgtttggcaacaccgacttccgagtgtacaacatcgacttccgcaacctgtgggcagagtacagcgatgggcccgcccatgcgatcagtttcagccgtgccaacggagggttctactactctggattctactcctaccaggacaccgtacgttcatacccctcatcctcgcttttgaacttcccacaaacgctgccggccaggtctacattggcaaactcggcaatgcctacttccacaagtccgtcattgccggccagaccgatttcctgtatggctttgggacggcctggattcagtcgtcctccattctcctgagatcgtgcggcggcggcatcacggcctggaagggcaccaacacgacgttcgagaacaactacggcgtgtacatcgtcgactcgacggtcaacgcagccaactcgtccctggtgtcggagatcaagggcaaatgtgcgctcggacggccctggaactcgctgcaccggtccatcttcgtgaacagctacgaagacggcagcatcgagccgtctggctacatcaactgggaggaccggtgggcggccaaccagacgctgatggccgagtaccgcgcctacggaccgggcttcaatgccactggccggaaggagggcggggtggccgtcctattgaatgcgcaggagtacaagcggtacgattcgctggagaaggtgttcttgacaccggagggtgaggcaggcaatatcgcttggattgattgggatatcgctggcaaggactga

SEQ ID NO: 71 - protein, 396 aa, Aspergillus aculeatus
MLLYRGLLLLLHVLLVHSAALQPRLSTATRETCQTSLKCPEGTIIVSNSSHPAAQFKSIQAAFASLPNDNSSHTILVLAGTYHEQLNLTRPGPVTLLGQQPDRSALTDPTRNRVTITWAAANQDNTGQSVDNVYSSVLIVSPTLDASLTGSGTTGFAVPADTPFGNTDFRVYNIDFRNLWAEYSDGPAHAISFSRANGGFYYSGFYSYQDTVYIGKLGNAYFHKSVIAGQTDFLYGFGTAWIQSSSILLRSCGGGITAWKGTNTTFENNYGVYIVDSTVNAANSSLVSEIKGKCALGRPWNSLHRSIFVNSYEDGSIEPSGYINWEDRWAANQTLMAEYRAYGPGFNATGRKEGGVAVLLNAQEYKRYDSLEKVFLTPEGEAGNIAWIDWDIAGKD

SEQ ID NO: 72 - protein, 377 aa, Aspergillus aculeatus
ALQPRLSTATRETCQTSLKCPEGTIIVSNSSHPAAQFKSIQAAFASLPNDNSSHTILVLAGTYHEQLNLTRPGPVTLLGQQPDRSALTDPTRNRVTITWAAANQDNTGQSVDNVYSSVLIVSPTLDASLTGSGTTGFAVPADTPFGNTDFRVYNIDFRNLWAEYSDGPAHAISFSRANGGFYYSGFYSYQDTVYIGKLGNAYFHKSVIAGQTDFLYGFGTAWIQSSSILLRSCGGGITAWKGTNTTFENNYGVYIVDSTVNAANSSLVSEIKGKCALGRPWNSLHRSIFVNSYEDGSIEPSGYINWEDRWAANQTLMAEYRAYGPGFNATGRKEGGVAVLLNAQEYKRYDSLEKVFLTPEGEAGNIAWIDWDIAGKD

SEQ ID NO: 73 - DNA, 1246 bp, Aspergillus aculeatus
  sig_peptide (1)..(54)
  exon (1)..(633)
  Intron (634)..(688)
  exon (689)..(1246)
atgcttctctatcgtggtcttctgcttcttttgcacgttctgcttgtgcactcggctgctctccagccgcgtctctcgacagctactcgggagacatgccagacgagtctgaaatgccctgagggcacgatcatcgtgtccaactcgtcgcaccccgccgctcaattcaagtctatccaggctgcgtttgcctccctccccaacgacaactcctcccacacaattctggtgcttgcaggaacctaccatgagcaactcaacctgacgcgcccgggccctgtcactttgctcggccagcaacccgatcgcagcgctctcaccgatcccactcgcaaccgcgtcaccatcacctgggctgctgccaaccaggacaataccggccagtcggtggacaacgtttactccagcgtgttgatcgtctcgcctaccttggacgccagtctgactgggtcgggtaccacagggtttgctgttcccgcggacacaccgtttggcaacaccgacttccgagtgtacaacatcgacttccgcaacctgtgggcagagtacagcgatgggcccgcccatgcgatcagtttcagccgtgccaacggagggttctactactctggattctactcctaccaggacaccgtacgttcataccctcatcttcacatttagatcacccactaacgcggcctgtcaggtctacattggcaaactcggcaatgcctacttccacaagtccatcattgccggccaaaccgatttcctgtatggctttgggaccgcctggatccaatcgtcctccattctcctgagatcatgcggcggcggcatcacggcctggaagggcaccaacacgacgtttgagaacaactacggcgtgtacatcgtcgactcgacggtcaacgcagccaactcgtccctggtgtccgagatcaagggcaaatgtgcgctcggacggccctggaactcgctgcaccggtccatcttcgtgaacagctacgaagacggcagcatcgagccgtctggctacatcaactgggaggaccggtgggcggccaaccagacgctgatggccgagtaccgcgcctacggaccgggcttcaatgccaccggccggaaggagggcggggtggccgtcctgttgaatgcacaggagtacaagcggtacgattcgctggagaaggtgttcttgacaccggagggtgaggcgggcaacatcgcctggattgattgggacatcgctggcaaagactga

SEQ ID NO: 74 - protein, 396 aa, Aspergillus aculeatus
MLLYRGLLLLLHVLLVHSAALQPRLSTATRETCQTSLKCPEGTIIVSNSSHPAAQFKSIQAAFASLPNDNSSHTILVLAGTYHEQLNLTRPGPVTLLGQQPDRSALTDPTRNRVTITWAAANQDNTGQSVDNVYSSVLIVSPTLDASLTGSGTTGFAVPADTPFGNTDFRVYNIDFRNLWAEYSDGPAHAISFSRANGGFYYSGFYSYQDTVYIGKLGNAYFHKSIIAGQTDFLYGFGTAWIQSSSILLRSCGGGITAWKGTNTTFENNYGVYIVDSTVNAANSSLVSEIKGKCALGRPWNSLHRSIFVNSYEDGSIEPSGYINWEDRWAANQTLMAEYRAYGPGFNATGRKEGGVAVLLNAQEYKRYDSLEKVFLTPEGEAGNIAWIDWDIAGKD

SEQ ID NO: 75 - protein, 377 aa, Aspergillus aculeatus
ALQPRLSTATRETCQTSLKCPEGTIIVSNSSHPAAQFKSIQAAFASLPNDNSSHTILVLAGTYHEQLNLTRPGPVTLLGQQPDRSALTDPTRNRVTITWAAANQDNTGQSVDNVYSSVLIVSPTLDASLTGSGTTGFAVPADTPFGNTDFRVYNIDFRNLWAEYSDGPAHAISFSRANGGFYYSGFYSYQDTVYIGKLGNAYFHKSIIAGQTDFLYGFGTAWIQSSSILLRSCGGGITAWKGTNTTFENNYGVYIVDSTVNAANSSLVSEIKGKCALGRPWNSLHRSIFVNSYEDGSIEPSGYINWEDRWAANQTLMAEYRAYGPGFNATGRKEGGVAVLLNAQEYKRYDSLEKVFLTPEGEAGNIAWIDWDIAGKD

SEQ ID NO: 76 - DNA, 1193 bp, Thielavia aculeatus
  sig_peptide (1)..(60)
  exon (1)..(723)
  Intron (724)..(779)
  exon (780)..(1193)
atgaggtcttccaccctcttttcctcggcgcttgcggcgctggcccaaacggcctccgccgccggcgtcaccggcgcggccgagggcttcgccaagggggtcaccggcggcggcaccgccacgcctgtctaccccacgagcacggcccagctggtctcgtacctgggcgactcgcagccgcgcgtcatcatgctggaccgcaccttcgacttcaccggatccgagggcacggcgaccgagacgggctgcgcgccctggggcacggcctcggcctgccagctcgccatcaacaagaacagctggtgcgacaactacgagcccaacgcgcccaaggtgtcggtcacgtacgacaaggcgggcgtgctgggcatcacggtggcgtccaacaagtcgctcgtcggcgtcgggagcaagggcatcatcaagggcaagggcctgcgcatcgtcagcggcgcgaagaacgtcatcatccagaacattcagattaccaacctcaaccccaagtacgtctggggcggcgacgccatcacgctcgacaacacggacctggtctggatcgaccacgtcaccacctcgctcatcggccgccagcatgtggtgctgggcaacaaccctagcgggcgggtgaccatctccaactccaagtttgacggccagagcacctactcggctacttgtgatacctaccactactggggcttgtactttaccggctccaacgacgtaggcggcccatcctcctctattcttcaatgtttatctgacaagctttggtatagatggtcaccctcaaaaacaacctcatctaccacatgtcgggccgctcccccaaggtggccggcaacaccctcctccacgcggtcaacaactactggtacgacagcacgggccactcgttcgaggccgacagcggcgccaagatcctggtcgagggctccgtgttccagaacatcgccacccctctcgaggccggcggcgcgggcaagatgctagccatcacgggcagcaacggtgggctctgctcgacctacctcggccggacctgccaggccaatggatttgggagctcggggacgctatccgggagtgatacgactttcttgtcgtacttttcggggaagaatatcgcgagtgcgacgacgtatactgcggcgaagagtgtgctgacgtcggctgggttcgggaccatctaa

SEQ ID NO: 77 - protein, 378 aa, Thielavia hyrcaniae
MRSSTLFSSALAALAQTASAAGVTGAAEGFAKGVTGGGTATPVYPTSTAQLVSYLGDSQPRVIMLDRTFDFTGSEGTATETGCAPWGTASACQLAINKNSWCDNYEPNAPKVSVTYDKAGVLGITVASNKSLVGVGSKGIIKGKGLRIVSGAKNVIIQNIQITNLNPKYVWGGDAITLDNTDLVWIDHVTTSLIGRQHVVLGNNPSGRVTISNSKFDGQSTYSATCDTYHYWGLYFTGSNDMVTLKNNLIYHMSGRSPKVAGNTLLHAVNNYWYDSTGHSFEADSGAKILVEGSVFQNIATPLEAGGAGKMLAITGSNGGLCSTYLGRTCQANGFGSSGTLSGSDTTFLSYFSGKNIASATTYTAAKSVLTSAGFGTI

SEQ ID NO: 78 - protein, 357 aa, Thielavia hyrcaniae
GVTGAAEGFAKGVTGGGTATPVYPTSTAQLVSYLGDSQPRVIMLDRTFDFTGSEGTATETGCAPWGTASACQLAINKNSWCDNYEPNAPKVSVTYDKAGVLGITVASNKSLVGVGSKGIIKGKGLRIVSGAKNVIIQNIQITNLNPKYVWGGDAITLDNTDLVWIDHVTTSLIGRQHVVLGNNPSGRVTISNSKFDGQSTYSATCDTYHYWGLYFTGSNDMVTLKNNLIYHMSGRSPKVAGNTLLHAVNNYWYDSTGHSFEADSGAKILVEGSVFQNIATPLEAGGAGKMLAITGSNGGLCSTYLGRTCQANGFGSSGTLSGSDTTFLSYFSGKNIASATTYTAAKSVLTSAGFGTI

SEQ ID NO: 79 - DNA, 1371 bp, Aspergillus luchuensis
  sig_peptide (1)..(60)
  exon (1)..(203)
  Intron (204)..(265)
  exon (266)..(409)
  Intron (410)..(466)
  exon (467)..(592)
  Intron (593)..(648)
  exon (649)..(979)
  Intron (980)..(1035)
  exon (1036)..(1371)
atgcactacaagctgcttttcgctgctgccgcggcatccctggccagcgctgtcagtgccgctggcgttgtaggcgccgccgagggttttgctcatggcgtcactggcggtggcagcgcttcccccgtctatcccacgactactgatgagctggtctcttacctgggagacaatgagcctcgtgtgattatcctggatagaacgtaggtcgatgcttcatttgggatacaggggtagacaattgtctaatacattgatctttcagcttcgactttaccggcaccgagggtaccgagactaccactggatgcgccccctggggaactgcctcccaatgccaggtggcgatcaacctgcacagttggtgcgacaactaccaggctagcgcccccaaggtatccgtgacttagtatgttgcccccgttcgaatgatgctcagactctcgccatgctgattgccgcatagtgataaggccggtatcctccccatcacggtcaattccaacaagagtatcgttggacagggcaccaagggtgtcatcaagggcaagggtctccgcgtggtcagcggcgccaagaacgtcattatccagtgagtgcggaccatcggtcgtaggatgtgaatccacccttgctaataacggccaggaacattgccgtcaccgacatcaaccccaagtatgtctggggtggtgatgccatcactgtcgatgactctgatctggtctggatcgatcatgtgacaactgctcgcattggtcgccagcacatcgtcctgggcaccagcgccgacaaccgtgtcaccatctcctactccctcatcgatggtcgttccgactactctgccacctgcaacggtcaacactactggggcgtgtacctggacggcagcaacgacatggtgactctcaagggcaactacttctacaacctgagcggccgcatgcccaaggtccagggtaacactctgctgcacgccgtatgtagtctttaccctctctaccatctgcacattgctgactactatgccgacaggtgaacaacctcttccacaacttcgatggccacgccttcgagatcggcactggtggttacgtcctggccgagggtaatgtcttccaggacgtcaacactgtggtagagacccccatcagcggccagctcttcagctccccggacgccaacatcaaccagcagtgtgcctccgtcttcggtcgctcctgccagctcaacgccttcggtaactccggctccatgtccggatctgacaccagcatcatcagcaagttcgctggcaagaccattgcgacggctcaccccccgggtaacattgcccagtggaccatgaagaacgctggccagggaaaataa

SEQ ID NO: 80 - protein, 379 aa, Aspergillus luchuensis
MHYKLLFAAAAASLASAVSAAGVVGAAEGFAHGVTGGGSASPVYPTTTDELVSYLGDNEPRVIILDRTFDFTGTEGTETTTGCAPWGTASQCQVAINLHSWCDNYQASAPKVSVTYDKAGILPITVNSNKSIVGQGTKGVIKGKGLRVVSGAKNVIIQNIAVTDINPKYVWGGDAITVDDSDLVWIDHVTTARIGRQHIVLGTSADNRVTISYSLIDGRSDYSATCNGQHYWGVYLDGSNDMVTLKGNYFYNLSGRMPKVQGNTLLHAVNNLFHNFDGHAFEIGTGGYVLAEGNVFQDVNTVVETPISGQLFSSPDANINQQCASVFGRSCQLNAFGNSGSMSGSDTSIISKFAGKTIATAHPPGNIAQWTMKNAGQGK

SEQ ID NO: 81 - protein, 358 aa, Aspergillus luchuensis
GVVGAAEGFAHGVTGGGSASPVYPTTTDELVSYLGDNEPRVIILDRTFDFTGTEGTETTTGCAPWGTASQCQVAINLHSWCDNYQASAPKVSVTYDKAGILPITVNSNKSIVGQGTKGVIKGKGLRVVSGAKNVIIQNIAVTDINPKYVWGGDAITVDDSDLVWIDHVTTARIGRQHIVLGTSADNRVTISYSLIDGRSDYSATCNGQHYWGVYLDGSNDMVTLKGNYFYNLSGRMPKVQGNTLLHAVNNLFHNFDGHAFEIGTGGYVLAEGNVFQDVNTVVETPISGQLFSSPDANINQQCASVFGRSCQLNAFGNSGSMSGSDTSIISKFAGKTIATAHPPGNIAQWTMKNAGQGK

SEQ ID NO: 82 - DNA, 940 bp, Aspergillus aculeatus
  sig_peptide (1)..(54)
  exon (1)..(288)
  Intron (289)..(369)
  exon (370)..(474)
  Intron (475)..(571)
  exon (572)..(940)
atgatgatctcgaggacgctagccctcttggccagtgtggccccggctctggcaaccaaaccggccgcattttacttggcaggtgactcgaccaccgcggcgcagtcctctgggggtggtgggtggggagtgggattcctggccacgctcaccggtggtgccattggcactgacctggggtataacggggacaccaccgcgagctttgtggcggggggcgcctgggcgaatgtcatcgatgccgtcacccgcagtaaggtctcctatcagccctacgtgaccattcaggtaagcaagggcccactcccaacaatcaaataagtagcggtcatggccatctctgacggacatctatctcgtataatctagttcggccacaacgatcagaagaacacctcgggggtcaccctcgaagactatgccacgaacctgcagaccatggcggaggcggtagtcaccgctggaggaatcccggtacgtgaagtcatccacatcataccgtcacccctcagacattggcattatgacaaggaccaactaacccacattcatttcttcccccggtgcccagatcctagtgactcccatctcccgccgcaccttcaactccaccacaggaacggtgattgaggacctggccacccagcgcaacatcaccatcagcgtcgcggagtccatcgccgtcgactatatcgacctgaatgaggccagcaccgtgtacctggacgccatcggggccacggacgcggccagctacaaccggatctccaccgactatacccacctgaacccggttggcagcgtcgttttcggcaacatggtgagctggctgttgctgaccaccacctcgctggccggcaatctggccgactataccgtgcccaacgcggagatcgtggccgctatcgccaatggcacctacatctatcccgaagtgtag

SEQ ID NO: 83 - protein, 253 aa, Aspergillus aculeatus
MMISRTLALLASVAPALATKPAAFYLAGDSTTAAQSSGGGGWGVGFLATLTGGAIGTDLGYNGDTTASFVAGGAWANVIDAVTRSKVSYQPYVTIQFGHNDQKNTSGVTLEDYATNLQTMAEAVVTAGGIPILVTPISRRTFNSTTGTVIEDLATQRNITISVAESIAVDYIDLNEASTVYLDAIGATDAASYNRISTDYTHLNPVGSVVFGNMVSWLLLTTTSLAGNLADYTVPNAEIVAAIANGTYIYPEV

SEQ ID NO: 84 - protein, 234 aa, Aspergillus aculeatus
KPAAFYLAGDSTTAAQSSGGGGWGVGFLATLTGGAIGTDLGYNGDTTASFVAGGAWANVIDAVTRSKVSYQPYVTIQFGHNDQKNTSGVTLEDYATNLQTMAEAVVTAGGIPILVTPISRRTFNSTTGTVIEDLATQRNITISVAESIAVDYIDLNEASTVYLDAIGATDAASYNRISTDYTHLNPVGSVVFGNMVSWLLLTTTSLAGNLADYTVPNAEIVAAIANGTYIYPEV

SEQ ID NO: 85 - DNA, 753 bp, Aspergillus aculeatus
  sig_peptide (1)..(51)
  CDS (1)..(753)
atgaagaccgccgctcttgcaccgctcttcttcctcccctctgccctcgccacgacggtctatctcgcgggtgactcgaccatggccaagaatggaggcgggtcgggaactaacggctggggcgagtacctcgccagttacctctccgcgacagtggttaacgacgcggtcgcgggccgcagcgcgcgctcgtacacacgcgagggtcggttcgagaacatcgccgatgtagtgacggcgggcgactacgtgatcgtcgagttcggccacaacgacggtggctcgctgtccacggacaatggacgcaccgactgctccggtaccggggcagaagtctgctatagcgtctacgacggggtcaacgagaccatcctcaccttccccgcctacctggagaacgccgccaagctgttcaccgccaagggcgccaaggtcattctcagcagccagacccccaacaacccctgggagaccggcaccttcgtcaactcccccacgcgcttcgttgagtacgccgagctggccgccgaggtcgctggcgtcgagtacgtcgaccactggtcctacgtggacagcatctatgagaccttgggcaatgccaccgtcaactcgtatttccccatcgatcacacccacaccagtcctgcgggcgcggaggtcgtggctgaggcgttcttgaaggcggtggtatgcacgggtacgtcgttgaagagtgtgttgacgacgacgagctttgaggggacatgtctgtga

SEQ ID NO: 86 - protein, 250 aa, Aspergillus aculeatus
MKTAALAPLFFLPSALATTVYLAGDSTMAKNGGGSGTNGWGEYLASYLSATVVNDAVAGRSARSYTREGRFENIADVVTAGDYVIVEFGHNDGGSLSTDNGRTDCSGTGAEVCYSVYDGVNETILTFPAYLENAAKLFTAKGAKVILSSQTPNNPWETGTFVNSPTRFVEYAELAAEVAGVEYVDHWSYVDSIYETLGNATVNSYFPIDHTHTSPAGAEVVAEAFLKAVVCTGTSLKSVLTTTSFEGTCL

SEQ ID NO: 87 - protein, 232 aa, Aspergillus aculeatus
TVYLAGDSTMAKNGGGSGTNGWGEYLASYLSATVVNDAVAGRSARSYTREGRFENIADVVTAGDYVIVEFGHNDGGSLSTDNGRTDCSGTGAEVCYSVYDGVNETILTFPAYLENAAKLFTAKGAKVILSSQTPNNPWETGTFVNSPTRFVEYAELAAEVAGVEYVDHWSYVDSIYETLGNATVNSYFPIDHTHTSPAGAEVVAEAFLKAVVCTGTSLKSVLTTTSFEGTCL

SEQ ID NO: 88 - DNA, 1020 bp, Aspergillus aculeatus
  sig_peptide (1)..(54)
  CDS (1)..(1020)
atgctcgctctctggcagtgcctagccctcgcggccatccctacagtatcagcattcccctccggttcgtctcagaaggcgttcgactgggactcgacgaaatacctaatagcgttcggtgattcctatacgtacgtgcagggcactcacggacaccaaaactatagcttcattggggatctgcagaacttcgcatatgatgctcagaccctgttaacggataagatcgttcagaaccagacagcaacggcagaagggggccccaactgggttgaatacctcaccgggtgcggggtagaagatggaatcatctcacccttggactgcgagagacaactctgggacttcgcgttcgcgggatctgatatctccgttgcatacacccccctccaccacaactacaccgtctccctcgtcaaccaggtcacccaattcacgacctacggccagccggtcctctcgcggcacatctccgcgccgcagacccttgtcgccatctggatcgggatcaacgacatcggcgacagcgccaaatacgccgtcgatttcccggccttctacgacaccctcatcaccaccctcttcgcctccgtccaggagatctacgcccagggctatcgctcctacctgttcgtcaacctgccgcccctcgaccgcaccccgggcaaccaggccctgagccagccctacccgaacgccacgcaggtcgcctggtacaacgacgcgctggcccggcacgccgccgccttccaccgcaaccacacggacacggccgtgcacctgtttgacgcgcaccggacgctcagcgaggtcatggaccaccccgcggcgtacggcatcgtcaacaccaccaacttctgccccgggtacgaccagcccgatatcgcgtggaactaccgggcgtacgggtgtccgaccccgctggaggagtacttctggttcaactcggggcatctgacgagccatgtgcatcagattcttgcgggtgtgttggagggggagctgagagagtggtcgaag

SEQ ID NO: 89 - protein, 340 aa, Aspergillus aculeatus
MLALWQCLALAAIPTVSAFPSGSSQKAFDWDSTKYLIAFGDSYTYVQGTHGHQNYSFIGDLQNFAYDAQTLLTDKIVQNQTATAEGGPNWVEYLTGCGVEDGIISPLDCERQLWDFAFAGSDISVAYTPLHHNYTVSLVNQVTQFTTYGQPVLSRHISAPQTLVAIWIGINDIGDSAKYAVDFPAFYDTLITTLFASVQEIYAQGYRSYLFVNLPPLDRTPGNQALSQPYPNATQVAWYNDALARHAAAFHRNHTDTAVHLFDAHRTLSEVMDHPAAYGIVNTTNFCPGYDQPDIAWNYRAYGCPTPLEEYFWFNSGHLTSHVHQILAGVLEGELREWSK

SEQ ID NO: 90 - protein, 321 aa, Aspergillus aculeatus
PSGSSQKAFDWDSTKYLIAFGDSYTYVQGTHGHQNYSFIGDLQNFAYDAQTLLTDKIVQNQTATAEGGPNWVEYLTGCGVEDGIISPLDCERQLWDFAFAGSDISVAYTPLHHNYTVSLVNQVTQFTTYGQPVLSRHISAPQTLVAIWIGINDIGDSAKYAVDFPAFYDTLITTLFASVQEIYAQGYRSYLFVNLPPLDRTPGNQALSQPYPNATQVAWYNDALARHAAAFHRNHTDTAVHLFDAHRTLSEVMDHPAAYGIVNTTNFCPGYDQPDIAWNYRAYGCPTPLEEYFWFNSGHLTSHVHQILAGVLEGELREWSK

SEQ ID NO: 91 - DNA, 825 bp, Colletotrichum gloeosporioides
  sig_peptide (1)..(66)
  exon (1)..(417)
  Intron (418)..(471)
  exon (472)..(825)
atgaggcttccaaccattgccgctaccctggtcacggccctgaccgccgttccattcagccaagccgccgcagttctctcgcgccaagacaccaagccaccttactttctcctcaccggcgactcaactgttgccgtgaacggcggttggggagatggattcctccgatatgtccagtctccggctgatggcaagaactatggcaagagcggagcgacgacggtctcattcagagcacagggcatctgggataccgtgataggggaagttgaggcgaacaaggacgccttcagccccatcgtgacgattcagttcggtcataacgaccagaaagaggcggccggcatctcccaggagcagttccaggcaaatcttcaaacacttgccaacgaggtgaaggccgcaggtggaactccggtaggcccctcaactattgtcttagaaatccccgcgaactaacatccaccgtagatcttgatcacatctctcacacgtcgggtcttcagcggcggcaaggtcatccagaacctcgaaaacgagcgcgtcagagccatcgcggctgctgaggccgtcggagccacctaccttgacctcaacaccgccagcaccaactacgtcaatgctatcggcaacgccaatggcaagaaatatgacctttcctctggcgattcaacccatctcaacgttgccggagagaccgtttttggccgtctggttgcggatctccttcttgaaaagcgccttgaccttgcgcaatacatcaaggagaaccaggcccttagcgacaagatcaaaaacggagagttcgcaacgggcgatgagtag

SEQ ID NO: 92 - protein, 256 aa, Colletotrichum gloeosporioides
MRLPTIAATLVTALTAVPFSQAAAVLSRQDTKPPYFLLTGDSTVAVNGGWGDGFLRYVQSPADGKNYGKSGATTVSFRAQGIWDTVIGEVEANKDAFSPIVTIQFGHNDQKEAAGISQEQFQANLQTLANEVKAAGGTPILITSLTRRVFSGGKVIQNLENERVRAIAAAEAVGATYLDLNTASTNYVNAIGNANGKKYDLSSGDSTHLNVAGETVFGRLVADLLLEKRLDLAQYIKENQALSDKIKNGEFATGDE

SEQ ID NO: 93 - protein, 233 aa, Colletotrichum gloeosporioides
AVLSRQDTKPPYFLLTGDSTVAVNGGWGDGFLRYVQSPADGKNYGKSGATTVSFRAQGIWDTVIGEVEANKDAFSPIVTIQFGHNDQKEAAGISQEQFQANLQTLANEVKAAGGTPILITSLTRRVFSGGKVIQNLENERVRAIAAAEAVGATYLDLNTASTNYVNAIGNANGKKYDLSSGDSTHLNVAGETVFGRLVADLLLEKRLDLAQYIKENQALSDKIKNGEFATGDE

SEQ ID NO: 94 - DNA, 2233 bp, Aspergillus oryzae
  sig_peptide (1)..(60)
  exon (1)..(256)
  Intron (257)..(311)
  exon (312)..(413)
  Intron (414)..(473)
  exon (474)..(595)
  Intron (596)..(650)
  exon (651)..(720)
  Intron (721)..(768)
  exon (769)..(844)
  Intron (845)..(891)
  exon (892)..(943)
  Intron (944)..(994)
  exon (995)..(1206)
  Intron (1207)..(1256)
  exon (1257)..(1478)
  Intron (1479)..(1550)
  exon (1551)..(1797)
  Intron (1798)..(1869)
  exon (1870)..(2010)
  Intron (2011)..(2072)
  exon (2073)..(2129)
  Intron (2130)..(2203)
  exon (2204)..(2233)
atgttgtccagaaccattcttttctcaacgtcttttctttgggtcagagtcgccaatgcggcctttggaatcaccacctctgacgactcctacgttattgacgctgggtcggcaaatcctctcaaatttacggtttcccgttcgagctgcgatattacctctatcaattactatggctcggaacttcagtactccggcacgggcagccacatcggttctggccttggaagcgcagatgtttctgcggtagaagatggtgagctaacgatagaacaagctatcctctatatactgatatcatgtctgtaaaggggactacatcaaggttacctgcgacaccgataccttgacacagtatttcgttgtccacaatggcgactcggtcattcacatggcgacgtacaccacagagggttagtttcacgtcacagcgcaaagaaagaaattcctgacattcgtcttaatcaattcagagccctccgttggtgagctgcggttcattgcccgccttaactcggagctcctaccgaacgaggaaccgttcggcgatgtgtccaccacttcgggcggcgaggcaatcgaaggctcggatgtggtaagtacaaaaatgaagctagggcacgaaggtagctgatgaaggctatatatagttcctcgtagatggggagacccgtagcaagttctactccagccagcgtttcatcgatgaccagagacattgtaaggcacgtactttctgactgtagcgtatggctaacctgcttctaggtgttgctggagacgcccaccgtgtttgcatgatcctcaaccaatacgagacttcctctggtggtcctttcttccggtcagtacactactgtgcgtaacatgcttacatactaattttaatagtgatatcaactccaacaacggcggtagttacaactccctctactggtacatggtacgtttgacacgacattatgcttttcaattatctcgttaacgaaggcagaactcgggccacgtccaaacagaagacagacgccagggtctccatgggccatactctatgtacttcagccgcagtggaacacccagcaccgatattgacacatccttcttcgcgaacctggacatcaagggctacgtcgctacagacggccgcggaactgtatccggaactgcatctggcgccgactccagcttcaaatgggtcgttcactggtacgatacccgtgcaataatagcatctaaatctgaccaccaaaatacaggtacaatgccgatgctcagtactggacatacacatcttcagacggtagcttcacttccccggccatgaagccaggcgattacaccatggtctactaccagggcgaatacaaggtagccgagacctctgtatctgttacagtcggatcatcaacaagcaaggacatctctggatccgtggaaaccggcgataccatcttcaagatcggcgactgggacggaacgtacgtgtcctattccaacccctgctagctagcaagccacccacatgggcataactgacttatcacctccagaccaaccggcttccgcaacgcagagaaccaactgcggatgcacccctcggactcgcgcatgtcatcttggggtccccttacctacaccgtaggaagctccgagctcaccgacttcccaatggctgccttcaagggcgttaacgaccccgtcacaatcaaattcacagccacttccgcccagaccggcgccgctactctgcgcatcggaacgaccctctcgttcgctggcggtcgtcctcaggctactgtaaggaaccccactgcaaaaccgactcacattcccatagaccgggaaccaaaataaactaacaaaaaccagatcaacgactacgaaggctccgctccctctgcacccacaaacctcaactcccgcggcgtcacccgcggagcctaccgtggcctcggcgaagtctacgacgtgaacattccatctggaacaatcgtcgaaggagagaacactgtgcgcatccctcaatacccttctccccttactcaaaagttcataattaacacaatcatcagatcacaatcagcgtcatctctggaagctccggcgatgagttccttgctcctaacttcgtaagtgcttacttattttctttgagttattgtcttagctgtggattgattggctaatgaattacttgttttagatctttgactgcgttgagttgttccagtaa

SEQ ID NO: 95 - protein, 528 aa, Aspergillus oryzae
MLSRTILFSTSFLWVRVANAAFGITTSDDSYVIDAGSANPLKFTVSRSSCDITSINYYGSELQYSGTGSHIGSGLGSADVSAVEDGDYIKVTCDTDTLTQYFVVHNGDSVIHMATYTTEEPSVGELRFIARLNSELLPNEEPFGDVSTTSGGEAIEGSDVFLVDGETRSKFYSSQRFIDDQRHCVAGDAHRVCMILNQYETSSGGPFFRDINSNNGGSYNSLYWYMNSGHVQTEDRRQGLHGPYSMYFSRSGTPSTDIDTSFFANLDIKGYVATDGRGTVSGTASGADSSFKWVVHWYNADAQYWTYTSSDGSFTSPAMKPGDYTMVYYQGEYKVAETSVSVTVGSSTSKDISGSVETGDTIFKIGDWDGTPTGFRNAENQLRMHPSDSRMSSWGPLTYTVGSSELTDFPMAAFKGVNDPVTIKFTATSAQTGAATLRIGTTLSFAGGRPQATINDYEGSAPSAPTNLNSRGVTRGAYRGLGEVYDVNIPSGTIVEGENTITISVISGSSGDEFLAPNFIFDCVELFQ

SEQ ID NO: 96 - protein, 507 aa, Aspergillus oryzae
FGITTSDDSYVIDAGSANPLKFTVSRSSCDITSINYYGSELQYSGTGSHIGSGLGSADVSAVEDGDYIKVTCDTDTLTQYFVVHNGDSVIHMATYTTEEPSVGELRFIARLNSELLPNEEPFGDVSTTSGGEAIEGSDVFLVDGETRSKFYSSQRFIDDQRHCVAGDAHRVCMILNQYETSSGGPFFRDINSNNGGSYNSLYWYMNSGHVQTEDRRQGLHGPYSMYFSRSGTPSTDIDTSFFANLDIKGYVATDGRGTVSGTASGADSSFKWVVHWYNADAQYWTYTSSDGSFTSPAMKPGDYTMVYYQGEYKVAETSVSVTVGSSTSKDISGSVETGDTIFKIGDWDGTPTGFRNAENQLRMHPSDSRMSSWGPLTYTVGSSELTDFPMAAFKGVNDPVTIKFTATSAQTGAATLRIGTTLSFAGGRPQATINDYEGSAPSAPTNLNSRGVTRGAYRGLGEVYDVNIPSGTIVEGENTITISVISGSSGDEFLAPNFIFDCVELFQ

SEQ ID NO: 97 - DNA, 1992 bp, Aspergillus oryzae
  sig_peptide (1)..(63)
  CDS (1)..(1992)
atgttcctcccctcacggaaggcattagccttcctagcttgccttgcaagccattccgtagcactcctaacaacatccgagaactcgacacacttcaacctcgctaacgaccgcttctccattgctttggccaagtccaatggtcatatcgttgacgtccaactagacggccaggatctacttgggccggtagacggcaacgccggaaagggtccatacctggactgttcctgcatcccgtcgggcttctggacgcccggtagcggcgctcatttagagcttatcaacggcacggactcgactggcaccgcatatggaggactttacatgagcgctacatatgcaggaaccaaccagacactatcgcaatggttcttcctccggggcgaagaaacaggactccatgccttttcccgagtcacatatttcaacgagaccaccccctccctacgaagtcttggagaattgcgcacactttttagaccgagcacggacctctggacgcacttctctaccagcgatggcaattacggaccaaagcctcttggcagcaacagtgggttggtagtccaggatgcgacaacctacatagggaacgttacggatgatccctatgtctcccaatactcggattactttaccaaatacactctggcggagagctggcgaaaccacgacgtccatgggctgtttagtgacggctcatctagttctgacggaagcacattcggcgcttggctagttcataacaccgttgagacgtactatggaggtcctctacactctgatcttgttgtcgatggcattgtgtataattatttggtctccggtcatcatggagcacctacgccaaacctcacgcatgggtttgatcgcacgtggggacctcaattttactactttaaccggggggattcggagacgacactcgccgatttgagggcagatgctgccaagtacgctgacccggagtggaatgctgagttctatgatagtatcgcggatcatattcccaatttcaccccgtcgactgggaggactacattcaagggaaaggtatcgctacccaaaggtgcaaagaggccaatcattgtgctctccgaggatggacaggacttccagctcaatgtcttcaacacggaatctctgcagtactgggctgagattgacaaatctggaagctttagcatcccccgtgttgtagaagggacatacagaataaccatttacgcggacgagatcttcggatggtttatccaagaccacgtcaaagttttgaaatcgcagtccaaagactacagcttcacctggaaagaggaaagcgcgggtaaagaaatctggcgtatcggtataccggataagtcttctggagagtacctgcatggctacgcaccggatacgtccaagccgctacaaccagaacaacatcgcatatactggggaaaatatgactacccagctgacttccccgagggaatcaacttccatgttggaaagagcgacccatcccaagacctcaattacattcattgggcattcttcccctctcagggaaatcatcttcgcactgagccatactatgacaatgtcaacaactggacggtgacattcgacctaactgcagaccagctccacaacacgaacacggcgacgttcaccgtgcagattgcaggtgcgaagaccgcgaacggcaacgcgaagtggacgcccgttgaagggaagtacagtaatcttccctggacggtgaatgtaaatggacggtatgagtccacatgggtgatcccgtactggcggagtggatcatgtggggtacgcagtgctgtttcctgccagaatatagagcagaagtttgcgtttccatcgaagaatctccaagaagggaagaatgagtttgttttgagtttgccgttcaatgcgtcgagtacggagactgcgttgctgccggatgcactttacgtgcagtatgatgcgctgaggttggagttggagtga

SEQ ID NO: 98 - protein, 663 aa, Aspergillus oryzae
MFLPSRKALAFLACLASHSVALLTTSENSTHFNLANDRFSIALAKSNGHIVDVQLDGQDLLGPVDGNAGKGPYLDCSCIPSGFWTPGSGAHLELINGTDSTGTAYGGLYMSATYAGTNQTLSQWFFLRGEETGLHAFSRVTYFNETTPSLRSLGELRTLFRPSTDLWTHFSTSDGNYGPKPLGSNSGLVVQDATTYIGNVTDDPYVSQYSDYFTKYTLAESWRNHDVHGLFSDGSSSSDGSTFGAWLVHNTVETYYGGPLHSDLVVDGIVYNYLVSGHHGAPTPNLTHGFDRTWGPQFYYFNRGDSETTLADLRADAAKYADPEWNAEFYDSIADHIPNFTPSTGRTTFKGKVSLPKGAKRPIIVLSEDGQDFQLNVFNTESLQYWAEIDKSGSFSIPRVVEGTYRITIYADEIFGWFIQDHVKVLKSQSKDYSFTWKEESAGKEIWRIGIPDKSSGEYLHGYAPDTSKPLQPEQHRIYWGKYDYPADFPEGINFHVGKSDPSQDLNYIHWAFFPSQGNHLRTEPYYDNVNNWTVTFDLTADQLHNTNTATFTVQIAGAKTANGNAKWTPVEGKYSNLPWTVNVNGRYESTWVIPYWRSGSCGVRSAVSCQNIEQKFAFPSKNLQEGKNEFVLSLPFNASSTETALLPDALYVQYDALRLELE

SEQ ID NO: 99 - protein, 641 aa, Aspergillus oryzae
LTTSENSTHFNLANDRFSIALAKSNGHIVDVQLDGQDLLGPVDGNAGKGPYLDCSCIPSGFWTPGSGAHLELINGTDSTGTAYGGLYMSATYAGTNQTLSQWFFLRGEETGLHAFSRVTYFNETTPSLRSLGELRTLFRPSTDLWTHFSTSDGNYGPKPLGSNSGLVVQDATTYIGNVTDDPYVSQYSDYFTKYTLAESWRNHDVHGLFSDGSSSSDGSTFGAWLVHNTVETYYGGPLHSDLVVDGIVYNYLVSGHHGAPTPNLTHGFDRTWGPQFYYFNRGDSETTLADLRADAAKYADPEWNAEFYDSIADHIPNFTPSTGRTTFKGKVSLPKGAKRPIIVLSEDGQDFQLNVFNTESLQYWAEIDKSGSFSIPRVVEGTYRITIYADEIFGWFIQDHVKVLKSQSKDYSFTWKEESAGKEIWRIGIPDKSSGEYLHGYAPDTSKPLQPEQHRIYWGKYDYPADFPEGINFHVGKSDPSQDLNYIHWAFFPSQGNHLRTEPYYDNVNNWTVTFDLTADQLHNTNTATFTVQIAGAKTANGNAKWTPVEGKYSNLPWTVNVNGRYESTWVIPYWRSGSCGVRSAVSCQNIEQKFAFPSKNLQEGKNEFVLSLPFNASSTETALLPDALYVQYDALRLELE

SEQ ID NO: 100 - DNA, 1584 bp, Aspergillus aculeatus
  sig_peptide (1)..(57)
  CDS (1)..(1584)
atgctcaaagcgtcgcttctgtcgttcgtggccttcacggcccaggtcgcccacgcggcctttggcatcaccaccagctccagcgcctatgtcatcgacaccaacgcgccaaaccagctgaagttcaccgtcagccgcagcagctgcgacattacctccatcatccactatggcacggagctgcagtactccagccagggcagtcacattgggtcgggtctgggctctgcgacggtgaccgccacgcagtccggggactatatcaaggtgacctgtgtgacggacaccttgacgcagtacatggtggtgcataatggggacccaatcattcacatggcgacatatatcactgccgagccgtcaatcggcgagctgcggttcatcgctcgactgaattcggacctgctaccgaacgaggagccgtttggcgacgtttccaccaccgctgacgggactgccattgagggatcagatgtgtttttggtcggcagtgaaacccgcagcaagttctactcgagcgagcgatttatcgacgatcagcgacactgcattgccggggatgcccaccgcgtttgcatgatcttgaatcaatacgaaagctcctccggaggtcctttccaccgggatatcaactcgaacaacggagggagctacaacgccctctactggtacatgaactccggccacgttcaaaccgagtcctaccggatgggtctccacggcccatactcgatgtactttagtcgcagcggtacccccagcaccagcatcgatacctcattcttcgccgaccttgacatcaaaggctatgttgccgcctcaggccgaggcaaagtggccggcacggcatccggagcagactcgagcatggattgggtggttcactggtacaacgatgcggcacagtactggacttataccagctccagcggcagcttcacctcgcccgccatgaagcccggaacgtacaccatggtctattaccaaggcgagtacgcggtcgccacgagctcggtcaccgtgtccgccggatcaaccacaacgaagaacatttcggggtccgtgaagaccggcactaccattttcaagattggtgaatgggacggacaaccgaccggcttccgcaacgcagccaaccagctccgcatgcacccctccgactcgcgcatgtcctcctggggtccactgacctatacggttggcagttccgctctgactgacttcccaatggccgtgttcaaaagcgtcaacaacccggtcaccatcaaattcaccgccacatccgcgcagaccggcgcagcgaccctgcgaatcgggacgaccttgtcgtttgccggtggacgaccccaggcgacgatcaacagctacacaggaagcgcaccagccgcgccgacaaacctggactctcggggcgtgacccgcggtgcgtaccggggattgggcgaggtgtatgatgtgtccatcccgtcggggacgatcgtcgcgggaacaaatacaattacgatcaacgtgatctctggcagttcgggggatacgtatttgagtccgaactttatctttgattgtgtggagttgttccagtag

SEQ ID NO: 101 - protein, 527 aa, Aspergillus aculeatus
MLKASLLSFVAFTAQVAHAAFGITTSSSAYVIDTNAPNQLKFTVSRSSCDITSIIHYGTELQYSSQGSHIGSGLGSATVTATQSGDYIKVTCVTDTLTQYMVVHNGDPIIHMATYITAEPSIGELRFIARLNSDLLPNEEPFGDVSTTADGTAIEGSDVFLVGSETRSKFYSSERFIDDQRHCIAGDAHRVCMILNQYESSSGGPFHRDINSNNGGSYNALYWYMNSGHVQTESYRMGLHGPYSMYFSRSGTPSTSIDTSFFADLDIKGYVAASGRGKVAGTASGADSSMDWVVHWYNDAAQYWTYTSSSGSFTSPAMKPGTYTMVYYQGEYAVATSSVTVSAGSTTTKNISGSVKTGTTIFKIGEWDGQPTGFRNAANQLRMHPSDSRMSSWGPLTYTVGSSALTDFPMAVFKSVNNPVTIKFTATSAQTGAATLRIGTTLSFAGGRPQATINSYTGSAPAAPTNLDSRGVTRGAYRGLGEVYDVSIPSGTIVAGTNTITINVISGSSGDTYLSPNFIFDCVELFQ

SEQ ID NO: 102 - protein, 507 aa, Aspergillus aculeatus
FGITTSSSAYVIDTNAPNQLKFTVSRSSCDITSIIHYGTELQYSSQGSHIGSGLGSATVTATQSGDYIKVTCVTDTLTQYMVVHNGDPIIHMATYITAEPSIGELRFIARLNSDLLPNEEPFGDVSTTADGTAIEGSDVFLVGSETRSKFYSSERFIDDQRHCIAGDAHRVCMILNQYESSSGGPFHRDINSNNGGSYNALYWYMNSGHVQTESYRMGLHGPYSMYFSRSGTPSTSIDTSFFADLDIKGYVAASGRGKVAGTASGADSSMDWVVHWYNDAAQYWTYTSSSGSFTSPAMKPGTYTMVYYQGEYAVATSSVTVSAGSTTTKNISGSVKTGTTIFKIGEWDGQPTGFRNAANQLRMHPSDSRMSSWGPLTYTVGSSALTDFPMAVFKSVNNPVTIKFTATSAQTGAATLRIGTTLSFAGGRPQATINSYTGSAPAAPTNLDSRGVTRGAYRGLGEVYDVSIPSGTIVAGTNTITINVISGSSGDTYLSPNFIFDCVELFQ

SEQ ID NO: 103 - DNA, 1123 bp, Aspergillus aculeatus
  sig_peptide (1)..(48)
  exon (1)..(324)
  Intron (325)..(394)
  exon (395)..(1123)
atgttcgcttctctgctgctggctgcgctgccccttcttacccacgccgcgctcacctatcgcggcgcagacatctcttctctcttgctgcttgaagatgagggctatagctataagaatctcaatggccaaacccaagccctagagacaattctcgccgatgctggcatcaattccattcgtcagcgtgtgtgggtgaaccccagcgacggcagctacgatctggactacaatttggagctggccaagcgggtcaaggcggctggcatgagtctttacctggacctgcacctgagtgacacatgggcggatcctagcgaccaggtgagtcggttgcattgtagcaatcatccagtcgatgtgatggctaggctgaccgcgtttgggacaatagacgacaccttccggctggtccacgaccgatctcggcactttgaaatggcagctgtacaactacacgctagaagtatgcaacacttttgcggagaacgatattgatatcgaaatcatctcgatcggcaatgagattcgtgccggtctcctctggcctctgggcgaaacgagcagctattcgaacatcggcgcactgctgcactcgggtgcttggggagtgaaggattccaacctggcgaccacccccaagatcatgatccatttggacgacggctggagctgggatcagcagaactacttttacgagaccgttctggccacgggcgagctgctgtccacggacttcgactactttggtgtctcctactacccgttctacagcgcgtcggcaactttggcatccctgaagactagtctggcgaacctgcagtcgacctacgacaagccggtggtggttgtggagacgaactggccggtctcgtgcccgaacccggcgtacgcattcccctcggatctgagctcgatccccttctcggtcgcgggccagcaggagttcctcgagaagttggcagccgtggtggaggccactactgatggtctgggagtgtactattgggagccagcctggatcggcaatgctgggttgggttcgagctgcgctgataacctgatggtggattacaccacggacgaagtgtacgagagcatcgagactctcggagagctctga

SEQ ID NO: 104 - protein, 350 aa, Aspergillus aculeatus
MFASLLLAALPLLTHAALTYRGADISSLLLLEDEGYSYKNLNGQTQALETILADAGINSIRQRVWVNPSDGSYDLDYNLELAKRVKAAGMSLYLDLHLSDTWADPSDQTTPSGWSTTDLGTLKWQLYNYTLEVCNTFAENDIDIEIISIGNEIRAGLLWPLGETSSYSNIGALLHSGAWGVKDSNLATTPKIMIHLDDGWSWDQQNYFYETVLATGELLSTDFDYFGVSYYPFYSASATLASLKTSLANLQSTYDKPVVVVETNWPVSCPNPAYAFPSDLSSIPFSVAGQQEFLEKLAAVVEATTDGLGVYYWEPAWIGNAGLGSSCADNLMVDYTTDEVYESIETLGEL

SEQ ID NO: 105 - protein, 333 aa, Aspergillus aculeatus
LTYRGADISSLLLLEDEGYSYKNLNGQTQALETILADAGINSIRQRVWVNPSDGSYDLDYNLELAKRVKAAGMSLYLDLHLSDTWADPSDQTTPSGWSTTDLGTLKWQLYNYTLEVCNTFAENDIDIEIISIGNEIRAGLLWPLGETSSYSNIGALLHSGAWGVKDSNLATTPKIMIHLDDGWSWDQQNYFYETVLATGELLSTDFDYFGVSYYPFYSASATLASLKTSLANLQSTYDKPVVVVETNWPVSCPNPAYAFPSDLSSIPFSVAGQQEFLEKLAAVVEATTDGLGVYYWEPAWIGNAGLGSSCADNLMVDYTTDEVYESIETLGEL

SEQ ID NO: 106 - DNA, 1140 bp, Aspergillus niger
  sig_peptide (1)..(60)
  CDS (1)..(1140)
atgaagtactctactatcttcagcgctgctgccgctgttttcgctggttccgccgctgccgtcggcgtgtccggctctgctgaaggtttcgccaagggcgtcaccggtggtggcagtgccacccccgtctaccccgacactatcgatgagctggtctcctaccttggtgatgatgaggcccgcgtcattgtcctgaccaagaccttcgacttcaccgacagcgaaggtaccaccactggcactggttgcgctccctggggtaccgcttccgcttgccaggttgctattgaccaggacgactggtgcgagaactacgagcccgatgctccctctgtcagcgttgaatactacaatgctggtaccctcggtatcactgtcacctccaacaagtccctcatcggtgagggctcctctggtgccattaagggcaagggtctccgcattgtcagcggtgccgagaacatcatcatccagaacatcgccgttaccgacatcaacgccaagtacgtctggggtggtgatgctattactcttgatgactgcgacctggtctggatcgaccacgttactaccgcccgcattggtcgccagcactacgtcctcggaaccagcgccgacaaccgcgtctctctcaccaacaactacattgacggtgtctccgactactccgccacctgcgatggctaccactactgggccatctacctcgacggtgatgccgacttggtcaccatgaagggcaactacatctaccacacctccggccgttcccccaaggtccaggacaacactctcctccacgctgtcaacaactactggtacgacatctccggccacgccttcgagatcggtgagggtggctacgtcttggctgagggcaacgttttccagaacgttgacactgttcttgagacctatgagggcgaggccttcaccgtcccctccaccaccgccggtgaagtctgctccacctaccttggccgtgactgtgtcatcaacggcttcggctcctccggcactttctccgaggacagcacctctttcctctccgacttcgagggcaagaacattgcctctgcttcggcttacacctctgttgcctctagcgttgttgccaacgccggtcagggcaacctgtga

SEQ ID NO: 107 - protein, 379 aa, Aspergillus niger
MKYSTIFSAAAAVFAGSAAAVGVSGSAEGFAKGVTGGGSATPVYPDTIDELVSYLGDDEARVIVLTKTFDFTDSEGTTTGTGCAPWGTASACQVAIDQDDWCENYEPDAPSVSVEYYNAGTLGITVTSNKSLIGEGSSGAIKGKGLRIVSGAENIIIQNIAVTDINAKYVWGGDAITLDDCDLVWIDHVTTARIGRQHYVLGTSADNRVSLTNNYIDGVSDYSATCDGYHYWAIYLDGDADLVTMKGNYIYHTSGRSPKVQDNTLLHAVNNYWYDISGHAFEIGEGGYVLAEGNVFQNVDTVLETYEGEAFTVPSTTAGEVCSTYLGRDCVINGFGSSGTFSEDSTSFLSDFEGKNIASASAYTSVASSVVANAGQGNL

SEQ ID NO: 108 - protein, 359 aa, Aspergillus niger
VGVSGSAEGFAKGVTGGGSATPVYPDTIDELVSYLGDDEARVIVLTKTFDFTDSEGTTTGTGCAPWGTASACQVAIDQDDWCENYEPDAPSVSVEYYNAGTLGITVTSNKSLIGEGSSGAIKGKGLRIVSGAENIIIQNIAVTDINAKYVWGGDAITLDDCDLVWIDHVTTARIGRQHYVLGTSADNRVSLTNNYIDGVSDYSATCDGYHYWAIYLDGDADLVTMKGNYIYHTSGRSPKVQDNTLLHAVNNYWYDISGHAFEIGEGGYVLAEGNVFQNVDTVLETYEGEAFTVPSTTAGEVCSTYLGRDCVINGFGSSGTFSEDSTSFLSDFEGKNIASASAYTSVASSVVANAGQGNL

SEQ ID NO: 109 - protein, 253 aa, Penicillium emersonii
MLSSTTRTLAFTGLAGLLSAPLVKAHGFVQGIVIGDQFYSGYIVNSFPYESNPPPVIGWATTATDLGFVDGTGYQGPDIICHRNATPAPLTAPVAAGGTVELQWTPWPDSHHGPVITYLAPCNGNCSTVDKTTLEFFKIDQQGLIDDTSPPGTWASDNLIANNNSWTVTIPNSVAPGNYVLRHEIIALHSANNKDGAQNYPQCINIEVTGGGSDAPEGTLGEDLYHDTDPGILVDIYEPIATYTIPGPPEPTF

SEQ ID NO: 110 - protein, 863 aa, Aspergillus fumigatus
MRFGWLEVAALTAASVANAQELAFSPPFYPSPWADGQGEWADAHRRAVEIVSQMTLAEKVNLTTGTGWEMDRCVGQTGSVPRLGINWGLCGQDSPLGIRFSDLNSAFPAGTNVAATWDKTLAYLRGKAMGEEFNDKGVDILLGPAAGPLGKYPDGGRIWEGFSPDPVLTGVLFAETIKGIQDAGVIATAKHYILNEQEHFRQVGEAQGYGYNITETISSNVDDKTMHELYLWPFADAVRAGVGAVMCSYNQINNSYGCQNSQTLNKLLKAELGFQGFVMSDWSAHHSGVGAALAGLDMSMPGDISFDDGLSFWGTNLTVSVLNGTVPAWRVDDMAVRIMTAYYKVGRDRLRIPPNFSSWTRDEYGWEHSAVSEGAWTKVNDFVNVQRSHSQIIREIGAASTVLLKNTGALPLTGKEVKVGVLGEDAGSNPWGANGCPDRGCDNGTLAMAWGSGTANFPYLVTPEQAIQREVISNGGNVFAVTDNGALSQMADVASQSSVSLVFVNADSGEGFISVDGNEGDRKNLTLWKNGEAVIDTVVSHCNNTIVVIHSVGPVLIDRWYDNPNVTAIIWAGLPGQESGNSLVDVLYGRVNPSAKTPFTWGKTRESYGAPLLTEPNNGNGAPQDDFNEGVFIDYRHFDKRNETPIYEFGHGLSYTTFGYSHLRVQALNSSSSAYVPTSGETKPAPTYGEIGSAADYLYPEGLKRITKFIYPWLNSTDLEDSSDDPNYGWEDSEYIPEGARDGSPQPLLKAGGAPGGNPTLYQDLVRVSATITNTGNVAGYEVPQLYVSLGGPNEPRVVLRKFDRIFLAPGEQKVWTTTLNRRDLANWDVEAQDWVITKYPKKVHVGSSSRKLPLRAPLPRVY

SEQ ID NO: 111 - protein, 532 aa, Aspergillus fumigatus
MLASTFSYRMYKTALILAALLGSGQAQQVGTSQAEVHPSMTWQSCTAGGSCTTNNGKVVIDANWRWVHKVGDYTNCYTGNTWDTTICPDDATCASNCALEGANYESTYGVTASGNSLRLNFVTTSQQKNIGSRLYMMKDDSTYEMFKLLNQEFTFDVDVSNLPCGLNGALYFVAMDADGGMSKYPTNKAGAKYGTGYCDSQCPRDLKFINGQANVEGWQPSSNDANAGTGNHGSCCAEMDIWEANSISTAFTPHPCDTPGQVMCTGDACGGTYSSDRYGGTCDPDGCDFNSFRQGNKTFYGPGMTVDTKSKFTVVTQFITDDGTSSGTLKEIKRFYVQNGKVIPNSESTWTGVSGNSITTEYCTAQKSLFQDQNVFEKHGGLEGMGAALAQGMVLVMSLWDDHSANMLWLDSNYPTTASSTTPGVARGTCDISSGVPADVEANHPDAYVVYSNIKVGPIGSTFNSGGSNPGGGTTTTTTTQPTTTTTTAGNPGGTGVAQHYGQCGGIGWTGPTTCASPYTCQKLNDYYSQCL

SEQ ID NO: 112 - protein, 454 aa, Aspergillus fumigatus
MKHLASSIALTLLLPAVQAQQTVWGQCGGQGWSGPTSCVAGAACSTLNPYYAQCIPGATATSTTLTTTTAATTTSQTTTKPTTTGPTTSAPTVTASGNPFSGYQLYANPYYSSEVHTLAMPSLPSSLQPKASAVAEVPSFVWLDVAAKVPTMGTYLADIQAKNKAGANPPIAGIFVVYDLPDRDCAALASNGEYSIANNGVANYKAYIDAIRAQLVKYSDVHTILVIEPDSLANLVTNLNVAKCANAQSAYLECVDYALKQLNLPNVAMYLDAGHAGWLGWPANLGPAATLFAKVYTDAGSPAAVRGLATNVANYNAWSLSTCPSYTQGDPNCDEKKYINAMAPLLKEAGFDAHFIMDTSRNGVQPTKQNAWGDWCNVIGTGFGVRPSTNTGDPLQDAFVWIKPGGESDGTSNSTSPRYDAHCGYSDALQPAPEAGTWFQAYFEQLLTNANPSF

SEQ ID NO: 113 - protein, 459 aa, Trichoderma reesei
MAPSVTLPLTTAILAIARLVAAQQPGTSTPEVHPKLTTYKCTKSGGCVAQDTSVVLDWNYRWMHDANYNSCTVNGGVNTTLCPDEATCGKNCFIEGVDYAASGVTTSGSSLTMNQYMPSSSGGYSSVSPRLYLLDSDGEYVMLKLNGQELSFDVDLSALPCGENGSLYLSQMDENGGANQYNTAGANYGSGYCDAQCPVQTWRNGTLNTSHQGFCCNEMDILEGNSRANALTPHSCTATACDSAGCGFNPYGSGYKSYYGPGDTVDTSKTFTIITQFNTDNGSPSGNLVSITRKYQQNGVDIPSAQPGGDTISSCPSASAYGGLATMGKALSSGMVLVFSIWNDNSQYMNWLDSGNAGPCSSTEGNPSNILANNPNTHVVFSNIRWGDIGSTTNSTAPPPPPASSTTFSTTRRSSTTSSSPSCTQTHWGQCGGIGYSGCKTCTSGTTCQYSNDYYSQCL

SEQ ID NO: 114 - protein, 515 aa, Bacillus stearothermophilus
AAPFNGTMMQYFEWYLPDDGTLWTKVANEANNLSSLGITALWLPPAYKGTSRSDVGYGVYDLYDLGEFNQKGTVRTKYGTKAQYLQAIQAAHAAGMQVYADVVFDHKGGADGTEWVDAVEVNPSDRNQEISGTYQIQAWTKFDFPGRGNTYSSFKWRWYHFDGVDWDESRKLSRIYKFRGIGKAWDWEVDTENGNYDYLMYADLDMDHPEVVTELKNWGKWYVNTTNIDGFRLDAVKHIKFSFFPDWLSYVRSQTGKPLFTVGEYWSYDINKLHNYITKTNGTMSLFDAPLHNKFYTASKSGGAFDMRTLMTNTLMKDQPTLAVTFVDNHDTEPGQALQSWVDPWFKPLAYAFILTRQEGYPCVFYGDYYGIPQYNIPSLKSKIDPLLIARRDYAYGTQHDYLDHSDIIGWTREGVTEKPGSGLAALITDGPGGSKWMYVGKQHAGKVFYDLTGNRSDTVTINSDGWGEFKVNGGSVSVWVPRKTTVSTIARPITTRPWTGEFVRWTEPRLVAWP

SEQ ID NO: 115 - protein, 177 aa, Thermoascus aurianticus
TRISSCSGSRQSALTTALRNAASLANAAADAAQSGSASKFSEYFKTTSSSTRQTVAARLRAVAREASSSSSGATTYYCDDPYGYCSSNVLAYTLPSYNIIANCDIFYTYLPALTSTCHAQDQATTALHEFTHAPGVYSPGTDDLAYGYQAAMGLSSSQAVMNADTYALYANAIYLGC

SEQ ID NO: 116 - protein, 412 aa, Pyrococcus furiosus
AELEGLDESAAQVMATYVWNLGYDGSGITIGIIDTGIDASHPDLQGKVIGWVDFVNGRSYPYDDHGHGTHVASIAAGTGAASNGKYKGMAPGAKLAGIKVLGADGSGSISTIIKGVEWAVDNKDKYGIKVINLSLGSSQSSDGTDALSQAVNAAWDAGLVVVVAAGNSGPNKYTIGSPAAASKVITVGAVDKYDVITSFSSRGPTADGRLKPEVVAPGNWIIAARASGTSMGQPINDYYTAAPGTSMATPHVAGIAALLLQAHPSWTPDKVKTALIETADIVKPDEIADIAYGAGRVNAYKAINYDNYAKLVFTGYVANKGSQTHQFVISGASFVTATLYWDNANSDLDLYLYDPNGNQVDYSYTAYYDFEKVGYYNPTDGTWTIKVVSYSGSANYQVDVVSDGSLSQPGSS

SEQ ID NO: 117 - protein, 325 aa, Palaeococcus ferrophilus
GKPKPSQPPQEVPWGIERVKAPSVWSTTDGSSNGVIQVAILDTGIDYDHPDLAANLAWGVSTLRGRVSTKPKDYRDQNGHGTHVAGTIAALNNDIGVVGVAPGVQIYAIRVLDASGRGSYSDIAIGIEQAILGPDGVADKDGDGIIAGDPDDDAAEVISMSLGGSADDSYLHDMIIQAYNAGIVIVAASGNEGASSPSYPAAYPEVIAVGASDINDNIASFSNRQPEVSAPGVDVLSTYPDDTYKTLSGTSMATPHVSGVVALIQAAHFNKYGTILPVGTFDDMSKNTVRGILHITADDLGSPGWDVDYGYGIVRADLAVQAALG

SEQ ID NO: 118 - protein, 186 aa, Thermobifida cellulosytica
ADVIGGNPYYFGGYRCSIGFSVRKGSDTGFATAGHCGETGTLTRSPEGVVAGSYFPGRDMGWVRLTGADTVTPLVNRYDGGTVTVTGSQEAVTGSSVCRSGSTTGWRCGIIQSKNQTVRYAEGTVTGLTRTTACAEAGDSGGPWLTGSQAQGVTSGGSGNCRTGGITYFQPINPLLSYFGLELVTG

SEQ ID NO: 119 - protein, 186 aa, Thermobifida fusca
AAIIGGNPYYFGNYRCSIGFSVRQGSQTGFATAGHCGSTGTRVSSPSGTVAGSYFPGRDMGWVRITSADTVTPLVNRYNGGTVTVTGSQEAATGSSVCRSGATTGWRCGTIQSKNQTVRYAEGTVTGLTRTTACAEGGDSGGPWLTGSQAQGVTSGGTGDCRSGGITFFQPINPLLSYFGLQLVTG

SEQ ID NO: 120 - protein, 186 aa, Thermobifida halotolerans
TDIIGGNPYYFDGYRCSIGFSVRRGSESGFATAGHCGEEGTETSDPEGTVAGAYFPGRDMGWVRITDADTVTPLVNRYNGENVTVAGSREAATGSSVCRSGSTTGWRCGTIRSKNQTVRYIEGTVTGLTRTTACAEGGDSGGPWLTGSQGQGVTSGGSGNCTLGGVTYFQPLNPLLSHFDLDLVTG

SEQ ID NO: 121 - protein, 325 aa, Thermococcus nautili
LVPEPTQPAQEIPWGIERVKAPDTWSITTGASNGVIEVAILDTGIDWDHPDLKDNIAWGVSTIGGEVSTDPADWYDGNGHGTHVAGTIAALNNDIGVVGVAPNVEIYAIKVLDDRGSGAYTDIAIGIEQALLGPDGILDKDGDGIIVGDPDDDAAEVISMSLGGPSDDEYLHDMIIKAYNYGVVIVAASGNEAADQPSYPAIYPEVIAVGATDSSDAVAYFSNLQPEVSAPGVDVLSTYPDDTYESLSGTSMATPHVSGVVALIQAAYYNKYGKVLPVGTFDDMNTNTVRGILHVTADDLGDPGWDIYYGYGIVRADLAVQAALG

SEQ ID NO: 122 - protein, 595 aa, Penicillium oxalicum
RPDPKGGNLTPFIHKEGERSLQGILDNLGGRGKKTPGTAAGLFIASPNTENPNYYYTWTRDSALTAKCLIDLFEDSRAKFPIDRKYLETGIRDYKSSQAILQSVSNPSGTLKDGSGLGEPKFEIDLNPFSGAWGRPQRDGPALRATAMITYANYLISHGQKSDVSQVMWPIIANDLAYVGQYWNNTGFDLWEEVDGSSFFTIAVQHRALVEGSQLAKKLGKSCDACDSQPPQILCFLQSFWNGKYITSNINTQASRSGIDLDSVLGSIHTFDPEAACDDATFQPCSARALANHKVYVDSFRSIYKINAGLAEGSAANVGRYPEDVYQGGNPWYLATLGASELLYDALYQWDRLGKLEVSETSLSFFKDFDATVKIGSYSRNSKTYKKLTQSIKSYADGFIQLVQQYTPSNGSLAEQYDRNTAAPLSANDLTWSFASFLTATQRRDAVVPPSWGAKSANKVPTTCSASPVVGTYKAPTATFSSKTKCVPAKDIVPITFYLIENTYYGENVFMSGNITALGNWDAKKGFPLTANLYTQDQNLWFASVEFIPAGTPFEYKYYKVEPNGDITWEKGPNRVFVAPTGCPVQPHSNDVWQF

SEQ ID NO: 123 - protein, 556 aa, Trametes cingulata
QSSAADAYVASESPIAKAGVLANIGPSGSKSNGAKAGIVIASPSTSNPNYLYTWTRDSSLVFKALIDQFTTGEDTSLRTLIDEFTSAEAILQQVPNPSGTVSTGGLGEPKFNIDETAFTDAWGRPQRDGPALRATAIITYANWLLDNKNTTYVTNTLWPIIKLDLDYVASNWNQSTFDLWEEINSSSFFTTAVQHRALREGATFANRIGQTSVVSGYTTQANNLLCFLQSYWNPTGGYITANTGGGRSGKDANTVLTSIHTFDPAAGCDAVTFQPCSDKALSNLKVYVDAFRSIYSINSGIASNAAVATGRYPEDSYMGGNPWYLTTSAVAEQLYDALIVWNKLGALNVTSTSLPFFQQFSSGVTVGTYASSSSTFKTLTSAIKTFADGFLAVNAKYTPSNGGLAEQYSRSNGSPVSAVDLTWSYAAALTSFAARSGKTYASWGAAGLTVPTTCSGSGGAGTVAVTFNVQATTVFGENIYITGSVPALQNWSPDNALILSAANYPTWSITVNLPASTTIEYKYIRKFNGAVTWESDPNNSITTPASGTFTQNDTWR

SEQ ID NO: 124 - protein, 591 aa, Talaromyces emersonii
ATGSLDSFLATETPIALQGVLNNIGPNGADVAGASAGIVVASPSRSDPNYFYSWTRDAALTAKYLVDAFIAGNKDLEQTIQQYISAQAKVQTISNPSGDLSTGGLGEPKFNVNETAFTGPWGRPQRDGPALRATALIAYANYLIDNGEASTADEIIWPIVQNDLSYITQYWNSSTFDLWEEVEGSSFFTTAVQHRALVEGNALATRLNHTCSNCVSQAPQVLCFLQSYWTGSYVLANFGGSGRSGKDVNSILGSIHTFDPAGGCDDSTFQPCSARALANHKVVTDSFRSIYAINSGIAEGSAVAVGRYPEDVYQGGNPWYLATAAAAEQLYDAIYQWKKIGSISITDVSLPFFQDIYPSAAVGTYNSGSTTFNDIISAVQTYGDGYLSIVEKYTPSDGSLTEQFSRTDGTPLSASALTWSYASLLTASARRQSVVPASWGESSASSVPAVCSATSATGPYSTATNTVWPSSGSGSSTTTSSAPCTTPTSVAVTFDEIVSTSYGETIYLAGSIPELGNWSTASAIPLRADAYTNSNPLWYVTVNLPPGTSFEYKFFKNQTDGTIVWEDDPNRSYTVPAYCGQTTAILDDSWQ

SEQ ID NO: 125 - protein, 555 aa, Pycnoporus sanguineus
QSSAVDAYVASESPIAKQGVLNNIGPNGSKAHGAKAGIVVASPSTENPDYLYTWTRDSSLVFKLLIDQFTSGDDTSLRGLIDDFTSAEAILQQVSNPSGTVSTGGLGEPKFNIDETAFTGAWGRPQRDGPALRATSIIRYANWLLDNGNTTYVSNTLWPVIQLDLDYVADNWNQSTFDLWEEVDSSSFFTTAVQHRALREGATFASRIGQSSVVSGYTTQADNLLCFLQSYWNPSGGYVTANTGGGRSGKDSNTVLTSIHTFDPAAGCDAATFQPCSDKALSNLKVYVDAFRSIYTINNGIASNAAVATGRYPEDSYMGGNPWYLTTSAVAEQLYDALYVWDQLGGLNVTSTSLAFFQQFASGLSTGTYSASSSTYATLTSAIRSFADGFLAINAKYTPADGGLAEQYSRNDGTPLSAVDLTWSYAAALTAFAAREGKTYGSWGAAGLTVPASCSGGGGATVAVTFNVQATTVFGENIYITGSVAALQNWSPDNALILSAANYPTWSITVNLPANTVVQYKYIRKFNGQVTWESDPNNQITTPSGGSFTQNDVWR

SEQ ID NO: 126 - protein, 556 aa, Gloeophyllum sepiarium
QSVDSYVSSEGPIAKAGVLANIGPNGSKASGASAGVVVASPSTSDPDYWYTWTRDSSLVFKSLIDQYTTGIDSTSSLRTLIDDFVTAEANLQQVSNPSGTLTTGGLGEPKFNVDETAFTGAWGRPQRDGPALRSTALITYGNWLLSNGNTSYVTSNLWPIIQNDLGYVVSYWNQSTYDLWEEVDSSSFFTTAVQHRALREGAAFATAIGQTSQVSSYTTQADNLLCFLQSYWNPSGGYITANTGGGRSGKDANTLLASIHTYDPSAGCDAATFQPCSDKALSNLKVYVDSFRSVYSINSGVASNAAVATGRYPEDSYQGGNPWYLTTFAVAEQLYDALNVWESQGSLEVTSTSLAFFQQFSSGVTAGTYSSSSSTYSTLTSAIKNFADGFVAINAKYTPSNGGLAEQYSKSDGSPLSAVDLTWSYASALTAFEARNNTQFAGWGAAGLTVPSSCSGNSGGPTVAVTFNVNAETVWGENIYLTGSVDALENWSADNALLLSSANYPTWSITVNLPASTAIEYKYIRKNNGAVTWESDPNNSITTPASGSTTENDTWR

SEQ ID NO: 127 - protein, 559 aa, Gloeophyllum trabeum
QSVDSYVGSEGPIAKAGVLANIGPNGSKASGAAAGVVVASPSKSDPDYWYTWTRDSSLVFKSLIDQYTTGIDSTSSLRSLIDSFVIAEANIQQVSNPSGTLTTGGLGEPKFNVDETAFTGAWGRPQRDGPALRATALITYGNWLLSNGNTTWVTSTLWPIIQNDLNYVVQYWNQTTFDLWEEVNSSSFFTTAVQHRALREGAAFATKIGQTSSVSSYTTQAANLLCFLQSYWNPTSGYITANTGGGRSGKDANTLLASIHTYDPSAGCDATTFQPCSDKALSNLKVYVDSFRSVYSINSGIASNAAVATGRYPEDSYQGGNPWYLTTFAVAEQLYDALNVWAAQGSLNVTSISLPFFQQFSSSVTAGTYASSSTTYTTLTSAIKSFADGFVAINAQYTPSNGGLAEQFSRSNGAPVSAVDLTWSYASALTAFEARNNTQFAGWGAVGLTVPTSCSSNSGGGGGSTVAVTFNVNAQTVWGENIYITGSVDALSNWSPDNALLLSSANYPTWSITVNLPASTAIQYKYIRKNNGAVTWESDPNNSITTPASGSVTENDTWR

SEQ ID NO: 128 - protein, 583 aa, Rhizomucor pusillus
ATSDDWKGKAIYQLLTDRFGRADDSTSNCSNLSNYCGGTYEGITKHLDYISGMGFDAIWISPIPKNSDGGYHGYWATDFYQLNSNFGDESQLKALIQAAHERDMYVMLDVVANHAGPTSNGYSGYTFGDASLYHPKCTIDYNDQTSIEQCWVADELPDIDTENSDNVAILNDIVSGWVGNYSFDGIRIDTVKHIRKDFWTGYAEAAGVFATGEVFNGDPAYVGPYQKYLPSLINYPMYYALNDVFVSKSKGFSRISEMLGSNRNAFEDTSVLTTFVDNHDNPRFLNSQSDKALFKNALTYVLLGEGIPIVYYGSEQGFSGGADPANREVLWTTNYDTSSDLYQFIKTVNSVRMKSNKAVYMDIYVGDNAYAFKHGDALVVLNNYGSGSTNQVSFSVSGKFDSGASLMDIVSNITTTVSSDGTVTFNLKDGLPAIFTSATGGTTTTATPTGSGSVTSTSKTTATASKTSTSTSSTSCTTPTAVAVTFDLTATTTYGENIYLVGSISQLGDWETSDGIALSADKYTSSDPLWYVTVTLPAGESFEYKFIRIESDDSVEWESDPNREYTVPQACGTSTATVTDTWR

SEQ ID NO: 129 - protein, 1020 aa, Talaromyces funiculosus
LPFNERVDQVLRSYEVTSKLDSRSTKPSKHGHTYQTQFLGVTWDQRNWRLQSTVLDQGHYESRGSIANGYIGLNVAGAGPLFELDSPVDGDVINGWPLFSRRQTFAGLAGFYDLQPRTNGTNFPWLSQYGDDSAISGVPHWGGMVLDLGDGEYLDATVDNSTISDYTTTYDYKAGVLSWDYKWTPKNANGSFGISYKIFANKLDVNQAVVQLSITPSTNGSASVVNVIDGYAAVRTDFVSSGNESDVVYTAVKPNGVTNVTAWIYTALDGDDAFDISSAALVNDKPYVHQNDSSIAQSVNVTFTAGTTITINKFVGAASTDAFPDPQSTAREAALSARRRGFDDLFRSHISEWAQVMPDDSVDDFTLANGTLPNDTFIIESAVMAVVNPYYLLQNTVGPNALRRVNNAPVNDWSIPVGGLTSDSYAGQIFWDADVWMQPGLVAAFPESAKRITNYRAAKYSQALENAKTAYTSSQNQTWFSPDAAIYSWTSGRVGNCTATGPCWDYEYHLNGDIGISLVNEWVVSGDNETFKNKHFPIYNSIATLYGDLLKKNGSYYTLTNMTDPDEYANNVDAGGYTMTLISQTLSNANAFRKQFGMNENTTWTEMADNILLIRENDVTLEYTTMNNSVAVKQADVILSTFPLDYTKNYTTSAALNDLDYYALKQSPDGPGMTYAIFSIVANDVSPSGCSAYTYAQYSYDPYIRGPFFQFSEQLLDDYTINGGTHPAFPFLTGHGGANQVVLYGYLGLRLLPDDMLHIDPNLPPQIPSIKYRTFYWRGWPIQAASNYTHTTIQRATTVAPLSTADPTYANKSIHVSVGHNTVNSTTYSLSANGSALVVPNRQIGSINTVAGNVVQCKSVLSTDAYQKGQYPISAVDGAASTKWQPEFAANISSLTVDLTGSNVSSVSGFYFDWAQAPPTNITVLLHNSSSAALASSGDKPGSSAVTLNITISNPYNASTYNANIIALPSSNSTNYTFPAPVPKPRYATLFVQGNQALDETDTKSGNGTGATVAEWAILS

SEQ ID NO: 130 - protein, 694 aa, Myceliophthora sepedonium
MALRHIAAAAIAGLASRTAALYINGSVTAPCDSPIYCQGELLKAVELARPFVDSKTFVDMPTIKPVDEVLAAFSKLSLPLSNNSELNAFLYENFAQAGHELEEVPDSELETDAKFLDKLEDRTIKEFVGKVIDIWPDLTRRYAGPSNCTECANSFIPVNRTFVVAGGRFREPYYWDSYWIVEGLLRTGGAFTHISKNIIENFLDFVDTIGFIPNGARIYYLNRSQPPLLTLMVKSYVDYTNDTSILDRALPLLIKEHEFFMNNRTVSITGSNGKEYTLNRYHVENNQPRPESFREDYITANNGSYYASSGIIYPVKTPLNETEKAALYSNLATGAESGWDYTSRWLGVPSDAARDVYFPLRSLNVRDIVPVDLNSILYQNEVIIAEYLEKAGNSSAAKRFATAAEQRSEAMYSLMWNATHWSYFDYNLTDNTQHIFVPADEDTAPQDRIEAPPGQQVFFHIAQLYPFWTGAAPASLKANPLAVQQAYARVARMLDIKKGAIPATNYRTGQQWDQPNVWPPLQHILMKGLLNTPATFGKSDPAYQSVQNLALRLAQRYLDSTFCTWYATGGSTSDFPQLEGVTPGATGVMFEKYADNATNVAGGGGEYEVVEGFGWTNGVLIWAADVFGNKLKRPDCGNITAAHTHSSAKRGLEENKLPRRAVELDPWDAAWTKMFGRSKLRRREAEDVRKRWMS

SEQ ID NO: 131 - DNA, 2105 bp, Pycnoporus sanguineus
atgcgcttcacactccttgcctctctcatcggcctcgccgtcggtgcctttgcacagtcgagcgcagtcgacgcgtacgtcgcgtccgagtcccccatcgccaagcagggcgtgctcaacaacatcggaccgaacggatccaaggcacacggcgccaaggtcggcaatccaccgctctacgtccaccttccgtccgtgcaggcgctaacaccacactttgtctgacaggccggcatcgtcgtagcaagcccgagcacagagaacccggactacctctacacatggacgcgcgactcctccctcgtcttcaagctgctcatcgaccagttcaccagcggcgacgacacgtccctccgcggtctcatcgacgacttcacctccgcggaggccatccttcagcaggtctcgaaccctagcgggaccgtctctacgggtggcttgggcgaacccaagttcaacatcgacgagaccgccttcaccggcgcatggggccgtcctcaacgcggtatgaatgcgcccccttcaatatctctccgcgccgtgctgatctctggcttcgccacatatgcagatggcccggccctgcgcgcgacgtccatcatccgctacgcgaactggctgctcgacaacggaaacacgacgtacgtgtcgaacacgctctggccggtcatccagctcgacctcgactacgtcgccgacaactggaaccagtccacgttcgacctatgggaggaggtcgactcgtcgtcgttctttaccactgccgtgcagcaccgcgcgctccgtgagggcgccacgttcgcgtcccgcatcggccagtcgtccgtcgtgagcgggtacaccacccaggcggacaacctgctatgcttccttcaggtgagccgatcccggcgctgtgtgagtgagtgaagtgggcattgactgactccgcgctcgcacagtcgtactggaaccccagtggaggatacgtgaccgcgaacacgggcggcggacgctccggcaaggactccaacaccgtgctcacctccatccacaccttcgaccccgctgccggttgcgacgccgcgaccttccagccatgctcggacaaggcgctctcgaacctcaaggtctacgtcgacgctttccgctccatctacaccatcaacaacggcatcgcctccaacgccgccgtcgctaccggccgttaccccgaggactcgtacatgggagggaacgtaagtaccattccctcacacagcatgccacggatactcacgtgcagtccctcgacagccctggtacctcaccacgtccgcggtcgcagagcagctctacgacgcgctctacgtctgggaccagctcggcgggctcaacgtcacgagcacctccctcgccttcttccagcagttcgcgtctgggctcagcacgggcacctactccgcctcctcgtccacgtacgccacgctcacgagcgcgatccgcagcttcgcggacggcttcctcgcgatcaacgcaaagtacacgcccgcggacggtgggctcgcggagcagtacagcagaaacgacggcacgccgctgagcgcggtcgacctcacgtggagctacgccgcggcgctcacggcgtttgcggcaagggaggggaagacgtacgggagctggggcgcggcggggctgacggtgcccgcgagctgctcgggcggcggaggcgctaccgttgcggtcacgttcaacgtccaggcgactactgtctttggtggtaagtcgatttgtgttctttcccgagcatggagggagtcgacgggatgctgacggcgtacctgcagagaacatctacatcaccggctccgtcgccgccctccaaaactggtccccggacaatgcgctcattctctccgccgcgaactacccgacctggagcagtacgtaccccgcctcatctcttctcgcccaccgcagcaggctgacgagcgcgcgcagtcacggtgaacctgccggcgaacacggtcgtgcagtacaagtacatccgcaagttcaacggacaggtcacctgggagtccgacccgaacaaccagatcacgacgccctcgggcgggtcgttcacacagaacgacgtgtggcggtaa

SEQ ID NO: 132 - DNA, 1749 bp, Artificial Sequence
  Rhizomucor pusillus alpha-amylase with A. niger glucoamylase linker and SBD
gcgacgtcggacgattggaagggtaaggccatttaccagttgctcacggaccgattcggtcgcgcagatgactcgacctcgaactgttcgaacctctcgaactactgtggtggcacttacgagggcatcactaaacatctcgactacatctccggtatgggcttcgatgcaatttggatttcgccgatccctaagaactcggacggtggataccacggttactgggccacagacttctatcagctcaactcgaacttcggcgacgagtcgcagttgaaagcgctcatccaggcggcccatgagcgggacatgtatgtcatgctcgatgtggtggcaaaccacgccggcccgacttcgaacggatactcgggttacactttcggtgatgcctccctctaccatccgaaatgtaccatcgattacaacgatcagacatcgatcgaacagtgttgggtcgccgatgagttgcccgatatcgacaccgaaaactcggacaacgtcgcaatcctcaacgacatcgtctccggctgggtgggtaactactcgttcgatggtattcggatcgacaccgtcaagcacatccgcaaggacttctggacaggttacgccgaagccgcgggtgtgttcgcgaccggagaggtgttcaacggagaccccgcatacgtgggaccctatcagaaatacttgccttccctcatcaactatcccatgtactacgccctcaacgacgtcttcgtctcgaagtcgaagggtttctccaggatttccgagatgttgggctcgaaccgtaacgccttcgaagatacttccgtcctcaccacgttcgtggacaaccacgacaaccctcgattcttgaactcccagtccgacaaagccctcttcaagaacgcgctcacatacgtgttgctcggcgaaggaatccccatcgtctactatggatcggaacagggcttctcgggcggtgcagaccctgccaaccgagaagtcctctggactacgaactacgacacgtcgtcggatctctaccagttcatcaagaccgtcaactcggtgcgtatgaagtcgaacaaggcggtgtacatggacatttacgtgggcgataacgcgtatgcattcaagcatggagacgccttggtggtcctcaacaactacggctcgggttcgaccaaccaggtgtccttctcggtgtcgggaaagttcgactccggcgcctccctcatggatatcgtgtccaacatcacaactactgtctcctcggatggcacagtcactttcaacttgaaggatggcctcccggcgattttcacctccgcaactggcggcaccactacgacggctacccccactggctccggcagcgtgacctcgaccagcaagaccaccgcgactgccagcaagaccagcaccagtacgtcatcaacctcctgtaccactcccaccgccgtggctgtgactttcgatctgacagctaccaccacctacggcgagaacatctacctggtcggatcgatctctcagctgggtgactgggaaaccagcgacggcatagctctgagtgctgacaagtacacttccagcgacccgctctggtatgtcactgtgactctgccggctggtgagtcgtttgagtacaagtttatccgcattgagagcgatgactccgtggagtgggagagtgatcccaaccgagaatacaccgttcctcaggcgtgcggaacgtcgaccgcgacggtgactgacacctggcgg

SEQ ID NO: 133 - DNA, 1690 bp, Aspergillus oryzae
  sig_peptide (1)..(57)
  exon (1)..(630)
  Intron (631)..(795)
  exon (796)..(834)
  Intron (835)..(888)
  exon (889)..(1090)
  Intron (1091)..(1157)
  exon (1158)..(1690)
atgcactctctatcacttatctccctcgccctcctctccccgttgctggtcaacgctcaactctcaggccatgtcggtcccctgacctcctctagctccaaagcgagcaccaaaacctgtaacgttcaagactacggcgccaaagcggacaaggagaccgacatcggctctgcgattgagaaggcatgggatgactgcgccgagggcggcgttgtctacatcccatcgggtgactatgctatgttctccaggctgaagctgtccgggggcaaagcctccgccattcagctagacggcattatctaccgcactggcagtgacggcggcaacctgttcatgattgaacattcgtcggactttgaattcttcagcagtacatctcagggtgcgattcagggattgggatacgaattccacaaggatggaagtctaaatggaccccggttgttgcgattctatgatgtgacagatttctcggtccatgatgttgcacttgttgactctccagcctttcacctctctttggatacgtgtaagaatgcagagatctataatatggctattcggggtggtgattccggtggtttggacggggttgatatttggagtgagaatgtttgggtccatgatgtatgttcttatttcctacttcttttctccctcctcttgagcgcttcttcgttgaccaaagttttctttctttctttccttcttcttttttattttattttattttattttattttatttattttaacttcacttgaaattgcggttaacggtatgtgtgtttaggttgaggtcacgaacaaggatgaatgtgtcacggtcaaggttggtttccttgcatcttctgtacaacagcctatatcactaactggagtacagagtcctgcgaagaacattctggtcgagaatatctattgtaactggagtggaggttgcgcgatgggatcgctgggtgcggacaccaacatcagcgacgtggtgtaccgtaacgtctacacatggaagtctaaccagatgtacatgatcaagagcaacggcggcagtggaagtgtctcgaacttggtattggagaactttatcggtatgcttacgtcttattcgtataccggtagagtcatatactaatagcagtggttgggatgtactaggtcatggtaatgcttactccttggacattgacggtgaatggagcagcatgagcactgtatcgggagacggtgtgcagctgaacaacatcaccgtgcgcaactggaagggtactgaggaagatggtgcggcaagagggccgattaaggtcgtgtgtgctgaaaaggcaccttgcactgatatcactatcgatgactttgcactgtggacagaatcgggcgatgaacagacctacagctgcgagaacggctttggaagcggattttgtctgcaggatggtgatggaacgtcttcttatagcacggttatcactgaaactgcggctccgacgggatacgaggcaagcagcatgtcaaatgatttgagcaccgcattcggaacggacgcttcgatcccgatccccactatacccacgtcctttttccctggcgccacgccctacagtgccctggcgggggctgcctcaggcaatgccgcgaaagccacatcatccgccacggcgtctcgtttccgccaccgtcgcgggtcccactaa

SEQ ID NO: 134 - protein, 467 aa, Aspergillus oryzae
MHSLSLISLALLSPLLVNAQLSGHVGPLTSSSSKASTKTCNVQDYGAKADKETDIGSAIEKAWDDCAEGGVVYIPSGDYAMFSRLKLSGGKASAIQLDGIIYRTGSDGGNLFMIEHSSDFEFFSSTSQGAIQGLGYEFHKDGSLNGPRLLRFYDVTDFSVHDVALVDSPAFHLSLDTCKNAEIYNMAIRGGDSGGLDGVDIWSENVWVHDVEVTNKDECVTVKSPAKNILVENIYCNWSGGCAMGSLGADTNISDVVYRNVYTWKSNQMYMIKSNGGSGSVSNLVLENFIGHGNAYSLDIDGEWSSMSTVSGDGVQLNNITVRNWKGTEEDGAARGPIKVVCAEKAPCTDITIDDFALWTESGDEQTYSCENGFGSGFCLQDGDGTSSYSTVITETAAPTGYEASSMSNDLSTAFGTDASIPIPTIPTSFFPGATPYSALAGAASGNAAKATSSATASRFRHRRGSH

SEQ ID NO: 135 - protein, 448 aa, Aspergillus oryzae
QLSGHVGPLTSSSSKASTKTCNVQDYGAKADKETDIGSAIEKAWDDCAEGGVVYIPSGDYAMFSRLKLSGGKASAIQLDGIIYRTGSDGGNLFMIEHSSDFEFFSSTSQGAIQGLGYEFHKDGSLNGPRLLRFYDVTDFSVHDVALVDSPAFHLSLDTCKNAEIYNMAIRGGDSGGLDGVDIWSENVWVHDVEVTNKDECVTVKSPAKNILVENIYCNWSGGCAMGSLGADTNISDVVYRNVYTWKSNQMYMIKSNGGSGSVSNLVLENFIGHGNAYSLDIDGEWSSMSTVSGDGVQLNNITVRNWKGTEEDGAARGPIKVVCAEKAPCTDITIDDFALWTESGDEQTYSCENGFGSGFCLQDGDGTSSYSTVITETAAPTGYEASSMSNDLSTAFGTDASIPIPTIPTSFFPGATPYSALAGAASGNAAKATSSATASRFRHRRGSH

SEQ ID NO: 136 - DNA, 1881 bp, Aspergillus aculeatus
  sig_peptide (1)..(69)
  exon (1)..(226)
  Intron (227)..(294)
  exon (295)..(911)
  Intron (912)..(974)
  exon (975)..(1880)
atgttggcatctatcgtgactgggttggctttcggcctactgtcgtccgcctcgccggtggcccggtcaaagccaaatccaccatttctgatcaatgtggacgatgaaacggctatccttggaaatgacttctggaatgccaccattggtcgtcagtatggcaccaagctctactacaaaaatgttgacctagtgggtgacgcatggggtcactatgtgtcctacagtacggccctcttccttatctcctccctctcattgtatctcttagtttacctctaatcttttgttcagatggcgctcaaagcgacttgaatcttaccaatgctcggatacacaaagtcactggcgactacaccgatgtcgtttttacagcgacagagggggaatttcattgggtcttgacgcccacgttgacgggcgcatatcagtacttcgtgaacaaagccttacctactcttggtgaattccgtactctctggcggcttgcaaacgatagctttacccacgggtggacggacgaaaggaacgaggcactgccacccttgtcggacattgtcaatgccgtcaagatccaagatgagacctggcagcaagctgacggcacatacatcacaaaatatgatttcgcaaccttcttgccggtaattgaagggcagtccgctctctggggactctacgggccgctgggtggccaagaggcgagtggcgagcaagttggctcgtggtatattcatgggggtaaagactacctgaacggcaaccatctgaagcaggagttgttggtgcaccgggagagtcagactggggatgcggtacagctgaacatgatccatggcacgcattatcaggccgtcagcagcgacgtgttcccggaaggtaagacctggggcccatggttgtggtacttggtaagtttcgcccacaattctcgccgtgttcagcgattctgacatatctgacaatcgtgacagaatgatggctccatccaagacgcggcgactcgcgccaaggaggagattgcggcttggccgtacgactggatgcaggatagccatggataccattcccgcggcagtcttcgaggacgcatcgtgctctccgacggccgggctgcgagcggggcggcagttttcttaggggacaaccagtccaatactagcacgttggaccagggagcctggtactactatcggacctatgccgatgagaacgggtactttaccttggagaatgtccgtgagggaacatggggccttcgtgttttcgctgctggaggcgacgcggcaggcggagtgaccactgtccttgagaaaaacaacatttccgtccacagcggtgaagccctatggttaggggacgtgacttgggctccgcaaggccgcgaggtcatctggcagattggcgaagtcgatcgcaaggctaccggctttgcctatagcggtgctccccaccaattcgcgaggggactcaactgcccggccaacctgaccttcaccgtgggaacgagccagagtaaggactggtgctttgagcagtcatcactgggtacgtggacggtggaatttgatcttccccgcaactcgacgtcccagggacggtcagcagtcctgtcagttgcgttggccgggtttagcgcagggagttcagctacggtctccgtgaatggggtttcagtcggagcgatcagctcgagtattcttgccagcgaccctagtagttatcggtgtggcacgttggcgggtgaatggcatctgctcgagtttccagtctcggcagatgcgcttcgcaatggggctaactccgtggagttcactatcaccaagtcgacactgtttcgcggatggatttatgacagcgtgttgttgggattgggcatga

SEQ ID NO: 137 - protein, 582 aa, Aspergillus aculeatus
MLASIVTGLAFGLLSSASPVARSKPNPPFLINVDDETAILGNDFWNATIGRQYGTKLYYKNVDLVGDAWGHYVSYNGAQSDLNLTNARIHKVTGDYTDVVFTATEGEFHWVLTPTLTGAYQYFVNKALPTLGEFRTLWRLANDSFTHGWTDERNEALPPLSDIVNAVKIQDETWQQADGTYITKYDFATFLPVIEGQSALWGLYGPLGGQEASGEQVGSWYIHGGKDYLNGNHLKQELLVHRESQTGDAVQLNMIHGTHYQAVSSDVFPEGKTWGPWLWYLNDGSIQDAATRAKEEIAAWPYDWMQDSHGYHSRGSLRGRIVLSDGRAASGAAVFLGDNQSNTSTLDQGAWYYYRTYADENGYFTLENVREGTWGLRVFAAGGDAAGGVTTVLEKNNISVHSGEALWLGDVTWAPQGREVIWQIGEVDRKATGFAYSGAPHQFARGLNCPANLTFTVGTSQSKDWCFEQSSLGTWTVEFDLPRNSTSQGRSAVLSVALAGFSAGSSATVSVNGVSVGAISSSILASDPSSYRCGTLAGEWHLLEFPVSADALRNGANSVEFTITKSTLFRGWIYDSVLLGWA

SEQ ID NO: 138 - protein, 559 aa, Aspergillus aculeatus
KPNPPFLINVDDETAILGNDFWNATIGRQYGTKLYYKNVDLVGDAWGHYVSYNGAQSDLNLTNARIHKVTGDYTDVVFTATEGEFHWVLTPTLTGAYQYFVNKALPTLGEFRTLWRLANDSFTHGWTDERNEALPPLSDIVNAVKIQDETWQQADGTYITKYDFATFLPVIEGQSALWGLYGPLGGQEASGEQVGSWYIHGGKDYLNGNHLKQELLVHRESQTGDAVQLNMIHGTHYQAVSSDVFPEGKTWGPWLWYLNDGSIQDAATRAKEEIAAWPYDWMQDSHGYHSRGSLRGRIVLSDGRAASGAAVFLGDNQSNTSTLDQGAWYYYRTYADENGYFTLENVREGTWGLRVFAAGGDAAGGVTTVLEKNNISVHSGEALWLGDVTWAPQGREVIWQIGEVDRKATGFAYSGAPHQFARGLNCPANLTFTVGTSQSKDWCFEQSSLGTWTVEFDLPRNSTSQGRSAVLSVALAGFSAGSSATVSVNGVSVGAISSSILASDPSSYRCGTLAGEWHLLEFPVSADALRNGANSVEFTITKSTLFRGWIYDSVLLGWA

SEQ ID NO: 139 - DNA, 1796 bp, Sporormia fimetaria
  sig_peptide (1)..(60)
  exon (1)..(618)
  Intron (619)..(668)
  exon (669)..(856)
  Intron (857)..(913)
  exon (914)..(1559)
  Intron (1560)..(1607)
  exon (1608)..(1796)
atgcgctacgtcacctacgctgcagctgcgcttgctttcgggcaaaacgcactcgctgcctttggccttacgtccaccagctctcggtttaaagtcgatacagacggaggattggttttcgaagtaaatcggtccgttgcaccctcagtatcgagcaagcgatttcaaacttaccaattattccgtagtgccaatggcgacatcaccagtctgaagtataatggggtcgaataccaaggtaccagcaaagcgagcgcaataaattccgggctagggacatcgactgtgaccggcgaaacagtaaccggatatgtaaaaattacagttaaagcggcctcgttgccggttacgcactacttcgttgcgaaaccaaaagaagccaccatttacatggccacgtatatcacaggagaggtggatccaggggagctgcgatggctggcacgactgaagacgtcggagttgccaaccggtgtacatggtaatgttggagatacgcgcggatgcacggcgttcgagggcaaagataccttcaagtgtccaaatggagaaacgcggtgcaagatgtatactagcgatcgatttattgatgacatcgtccatggagtttcgggatcggtgagtacgcttggtcattagcttcctggggagtagctgacgtcgcttagaaagctgccgtttggatggtaatgccgggcgtcgcatatgagtcttcggccagtggtccattcatgcgggacatcaatagtcaaacaggagatagcgaccaggagctctactggtacatgaacagcggccacgtccgcacggagccatggcgatttggcctccaagggccgtatgcaatggcttttacgtaagtgcctacaaaccttggagtttttcagcaaagcggctgttaacatctgcaaagtgccccaggagcaaagccttcagcagatttggataccagcttcttcagtgggttgagcattcagggctacgttccgagcagtggccgagggactgtctccggcgctgcgactggcgttccagacaaattcgaaacagtggttcactggcacaatacacaggcccagtactggaccaaggcaaccaaaggagcgtacaagtcacccctcatgaagccaggatcgtataccatgaagctatacaaaggcgaattccttgtggcaactgactcagtaactgtgacggccgggcaaaacgtgattaaggacatcgcctcgaaggaggccaatacgcccgtcatttggagaatcggagaattcgatggccagccattcgaattgaagaatggagataagatcgagcgcatgcatccgtcagacacgcgtatgggcagctggggaggagcctacactgtgggccagtcttctgccaaggactttcctatggcgctctggtccaagcaaagcggcgctgctacagtcaatttttccctgacacaagatcaagtgaaggctcacgttctgcgcattggaaccacgttatccttcaagggtggccgtccctcagtcaaaatcggaagctggacaggtagcgatccgggagcaccggtaagtaggtcggaaaggagagggacatatatgctcactactgaatagaaactcatcgattcacgtggtgtaacccggggcgcctatcgaggatatggtgatgtttacacctggaccgttccagcaagtgctttcaaggcgggcgccaacacattgactattggcgtgagcggaagtggagacgcaacttggctaagcgccaactacatcgtagatgctatagagttacaggactag

SEQ ID NO: 140 - protein, 546 aa, Sporormia fimetaria
MRYVTYAAAALAFGQNALAAFGLTSTSSRFKVDTDGGLVFEVNRSVAPSVSSKRFQTYQLFRSANGDITSLKYNGVEYQGTSKASAINSGLGTSTVTGETVTGYVKITVKAASLPVTHYFVAKPKEATIYMATYITGEVDPGELRWLARLKTSELPTGVHGNVGDTRGCTAFEGKDTFKCPNGETRCKMYTSDRFIDDIVHGVSGSKAAVWMVMPGVAYESSASGPFMRDINSQTGDSDQELYWYMNSGHVRTEPWRFGLQGPYAMAFTAPGAKPSADLDTSFFSGLSIQGYVPSSGRGTVSGAATGVPDKFETVVHWHNTQAQYWTKATKGAYKSPLMKPGSYTMKLYKGEFLVATDSVTVTAGQNVIKDIASKEANTPVIWRIGEFDGQPFELKNGDKIERMHPSDTRMGSWGGAYTVGQSSAKDFPMALWSKQSGAATVNFSLTQDQVKAHVLRIGTTLSFKGGRPSVKIGSWTGSDPGAPKLIDSRGVTRGAYRGYGDVYTWTVPASAFKAGANTLTIGVSGSGDATWLSANYIVDAIELQD

SEQ ID NO: 141 - protein, 527 aa, Sporormia fimetaria
AFGLTSTSSRFKVDTDGGLVFEVNRSVAPSVSSKRFQTYQLFRSANGDITSLKYNGVEYQGTSKASAINSGLGTSTVTGETVTGYVKITVKAASLPVTHYFVAKPKEATIYMATYITGEVDPGELRWLARLKTSELPTGVHGNVGDTRGCTAFEGKDTFKCPNGETRCKMYTSDRFIDDIVHGVSGSKAAVWMVMPGVAYESSASGPFMRDINSQTGDSDQELYWYMNSGHVRTEPWRFGLQGPYAMAFTAPGAKPSADLDTSFFSGLSIQGYVPSSGRGTVSGAATGVPDKFETVVHWHNTQAQYWTKATKGAYKSPLMKPGSYTMKLYKGEFLVATDSVTVTAGQNVIKDIASKEANTPVIWRIGEFDGQPFELKNGDKIERMHPSDTRMGSWGGAYTVGQSSAKDFPMALWSKQSGAATVNFSLTQDQVKAHVLRIGTTLSFKGGRPSVKIGSWTGSDPGAPKLIDSRGVTRGAYRGYGDVYTWTVPASAFKAGANTLTIGVSGSGDATWLSANYIVDAIELQD

SEQ ID NO: 142 - DNA, 1338 bp, Penicillium oxalicum
  sig_peptide (1)..(60)
  exon (1)..(261)
  Intron (262)..(327)
  exon (328)..(750)
  Intron (751)..(805)
  exon (806)..(935)
  Intron (936)..(1009)
  exon (1010)..(1338)
atggttctcagtctcaaactctgccttgccggcctggccagcgccgccgctgtccaagccattcccaacaccattccggagttggatatcatttctacctcttccctggaggagcgggcctcgtcctgcaccttctccggggccaacggtgccgccgcggccatcaaggccaagaccacttgctcgaccattgtcctgtcgtcggtggccgttcccgccggaacaacccttgacctgacgggtctgaagcagggcaccacggtgagttcagacattgacacatgttttgaaaaacaaatgggaatgtccgctgagtggttcacctaggtcatcttcgagggtactaccacttttggctacaaggagtgggagggtcccctggtctcggtttctggaactgatatcaccgtcaagggtgcctctggctccgtgctcaacggagatggtgctcgctggtgggacaccaagggatccaacggtggcaagaagaagcccaagttcttctctgcccacaagttgatcaactccaagatccagagcctcaccatcaagaactcgcccgtgcaggtcttcagcatcaacggcgcgcaggcattgcacctcgacagcatcaccatcgacaatgcggatggtgacaccaagggtggccacaacaccgacgcctttgatgtcggttccagtactggtgtctacatcaccaaccctattgttcacaaccaggacgactgcctggcgatcaactcgggcactgtacgtgagccgcatgtgaaatgttttgaaatggcatactgaccatccttggtaggacatccacttcactggagctcagtgtgttggtggccatggtatctccattggctctgtcggcggccgctccgacaacaccgtgtccaaggtgaccattcagggatgcaccatcaaggactcggacaacggtaagtcgcgcaagaacgaagctttccgccaatcatccaaatgccccctgagactgactcggggaaaaattcaggtgttcgcatcaagactgtctacggcgccactggctcggtcaaggacgtcatctaccaggacatcactctttccaacatcagcaagtacggcgttgtcatcgagcaggactacgagaacggcagccctactggcaagcccaccggcggtgttcccatcaccggcctgaccctgaacaacgtgaagggatccgtcgccagcaagggtaccaacatttacgttctctgtgcttcgggtgcttgttctggctggaagtggagtggtgtcaacgtgactggtggtaagaccagcaccaagtgcctcaatgttcccggtagtgccaagtgctag

SEQ ID NO: 143 - protein, 380 aa, Penicillium oxalicum
MVLSLKLCLAGLASAAAVQAIPNTIPELDIISTSSLEERASSCTFSGANGAAAAIKAKTTCSTIVLSSVAVPAGTTLDLTGLKQGTTVIFEGTTTFGYKEWEGPLVSVSGTDITVKGASGSVLNGDGARWWDTKGSNGGKKKPKFFSAHKLINSKIQSLTIKNSPVQVFSINGAQALHLDSITIDNADGDTKGGHNTDAFDVGSSTGVYITNPIVHNQDDCLAINSGTDIHFTGAQCVGGHGISIGSVGGRSDNTVSKVTIQGCTIKDSDNGVRIKTVYGATGSVKDVIYQDITLSNISKYGVVIEQDYENGSPTGKPTGGVPITGLTLNNVKGSVASKGTNIYVLCASGACSGWKWSGVNVTGGKTSTKCLNVPGSAKC

SEQ ID NO: 144 - protein, 360 aa, Penicillium oxalicum
IPNTIPELDIISTSSLEERASSCTFSGANGAAAAIKAKTTCSTIVLSSVAVPAGTTLDLTGLKQGTTVIFEGTTTFGYKEWEGPLVSVSGTDITVKGASGSVLNGDGARWWDTKGSNGGKKKPKFFSAHKLINSKIQSLTIKNSPVQVFSINGAQALHLDSITIDNADGDTKGGHNTDAFDVGSSTGVYITNPIVHNQDDCLAINSGTDIHFTGAQCVGGHGISIGSVGGRSDNTVSKVTIQGCTIKDSDNGVRIKTVYGATGSVKDVIYQDITLSNISKYGVVIEQDYENGSPTGKPTGGVPITGLTLNNVKGSVASKGTNIYVLCASGACSGWKWSGVNVTGGKTSTKCLNVPGSAKC

SEQ ID NO: 145 - DNA, 1413 bp, Talaromyces sp. XZ2925
  sig_peptide (1)..(57)
  CDS (1)..(1413)
atgaagtctattctggctgtatgcctctgggcaagcgccgttgtagctctcgcagctgacaaaaataagcataagccaactccagtcgtgacatactctgacttccctacgacactaagtgcttctcagatcacaattccgtactctactccctctggctatgtcttcggaagtaaaactacaccatttagtgtacctacaaaggtatctactgctgtagctgagtgcattgtgaccccgctcggctggggtcaagatgactctggtcagatcatggctgcagtcgaggagtgtggtatggatgggataatcacgttaccagctccatatgtatatacaattagccagcggatgtacatgaagctggttcgtgctcgactaaatatctttgggacgctctctttcgagcctaatcttggatattggattgacaactcgcatcgagtggagtttcaaaaccaaagcactgcgtggattgtcgaaggaagtgattttgttatctccggtggcggctggcaacaaggcggaatcaatggtaacggacagccatggtatggtagggcagctggacagagcaaccagtacggtcgaccgatctctctcacaatttggcaagggaacaacgtcactgttgaagatttctccattcgtcagcctcagttctggtccttctttatccaggactcacaagacgtgaaattaaccaatatttacattaacggaacaaacactgatccggccggcaattcatcaaactacgaaaccaacgttgatgggtttgactctatccgagttaacggtctagaaacttcaaactggcttttccacggtggcgacgactgccatgcgccaaaaggcaattctaccaatatggtcttccacaacctaacctgtgttggcgggggaattgcctttggcagcatcggtcagtatgcggacatgcccgactatatttcgaacgtgtctgcaacaaatatcagcgtgacccagcagatttcacctctgtatggcggtgcaactgtgaatggcgcggcatacttcaaatcctgggtgggcgtcgccgaaggcacacctcctcaaggcggcggcggcggcacaggacgcgtgtggaacatcagcttttcggacctagaagtgcataacaccacacaggcgatctatatcaacaaatgttactacaaggtggccgaccaggcaaactactgcgacacgtcgacccttgagttcgagaacatgactttcaccgatgtcaagggccaagtgaattccaaatacggtgtctcactgaactgttcggctaaggccccgtgcgaaaatatgaattttgtgggtttggatctgacgttggctaatggcacggtagctggtgattactgtgataatgtggcgagctcgacaggtatcagctgttaa

SEQ ID NO: 146 - protein, 470 aa, Talaromyces sp. XZ2925
MKSILAVCLWASAVVALAADKNKHKPTPVVTYSDFPTTLSASQITIPYSTPSGYVFGSKTTPFSVPTKVSTAVAECIVTPLGWGQDDSGQIMAAVEECGMDGIITLPAPYVYTISQRMYMKLVRARLNIFGTLSFEPNLGYWIDNSHRVEFQNQSTAWIVEGSDFVISGGGWQQGGINGNGQPWYGRAAGQSNQYGRPISLTIWQGNNVTVEDFSIRQPQFWSFFIQDSQDVKLTNIYINGTNTDPAGNSSNYETNVDGFDSIRVNGLETSNWLFHGGDDCHAPKGNSTNMVFHNLTCVGGGIAFGSIGQYADMPDYISNVSATNISVTQQISPLYGGATVNGAAYFKSWVGVAEGTPPQGGGGGTGRVWNISFSDLEVHNTTQAIYINKCYYKVADQANYCDTSTLEFENMTFTDVKGQVNSKYGVSLNCSAKAPCENMNFVGLDLTLANGTVAGDYCDNVASSTGISC

SEQ ID NO: 147 - protein, 451 aa, Talaromyces sp. XZ2925
DKNKHKPTPVVTYSDFPTTLSASQITIPYSTPSGYVFGSKTTPFSVPTKVSTAVAECIVTPLGWGQDDSGQIMAAVEECGMDGIITLPAPYVYTISQRMYMKLVRARLNIFGTLSFEPNLGYWIDNSHRVEFQNQSTAWIVEGSDFVISGGGWQQGGINGNGQPWYGRAAGQSNQYGRPISLTIWQGNNVTVEDFSIRQPQFWSFFIQDSQDVKLTNIYINGTNTDPAGNSSNYETNVDGFDSIRVNGLETSNWLFHGGDDCHAPKGNSTNMVFHNLTCVGGGIAFGSIGQYADMPDYISNVSATNISVTQQISPLYGGATVNGAAYFKSWVGVAEGTPPQGGGGGTGRVWNISFSDLEVHNTTQAIYINKCYYKVADQANYCDTSTLEFENMTFTDVKGQVNSKYGVSLNCSAKAPCENMNFVGLDLTLANGTVAGDYCDNVASSTGISC

SEQ ID NO: 148 - DNA, 49 bp, Artificial Sequence
  forward primer
acacaactggggatccaccatgaaagcccctattttatcattgtgtgcc

SEQ ID NO: 149 - DNA, 44 bp, Artificial Sequence
  reverse primer
cctctagatctcgagctagttcgaacattgaactcctgagaccc

SEQ ID NO: 150 - DNA, 48 bp, Artificial Sequence
  forward primer
acacaactggggatccaccatgaagtctattctgagtgtagccgtctg

SEQ ID NO: 151 - DNA, 44 bp, Artificial Sequence
  reverse primer
ccctctagatctcgagtcaacatgtgatacctgttgagctctgc

SEQ ID NO: 152 - DNA, 48 bp, Artificial Sequence
  forward primer
acacaactggggatccaccatgagagcctttgctctatatgtactggc

SEQ ID NO: 153 - DNA, 43 bp, Artificial Sequence
  reverse primer
ccctctagatctcgagctaattctccaccgcacaattagcacc

SEQ ID NO: 154 - DNA, 40 bp, Artificial Sequence
  forward primer
acacaactggggatccaccatgcgctacgtcacctacgct

SEQ ID NO: 155 - DNA, 51 bp, Artificial Sequence
  reverse primer
ccctctagatctcgagctagtcctgtaactctatagcatctacgatgtagt

SEQ ID NO: 156 - DNA, 45 bp, Artificial Sequence
  forward primer
acacaactggggatccaccatggttctcagtctcaaactctgcct

SEQ ID NO: 157 - DNA, 38 bp, Artificial Sequence
  reverse primer
ccctctagatctcgagctagcacttggcactaccggga

SEQ ID NO: 158 - DNA, 47 bp, Artificial Sequence
  forward primer
acacaactggggatccaccatgaagtctattctggctgtatgcctct

SEQ ID NO: 159 - DNA, 42 bp, Artificial Sequence
  reverse primer
ccctctagatctcgagttaacagctgatacctgtcgagctcg

What is claimed is:

1. A process for producing ethanol from starch-containing material comprising the steps of:

i) liquefying the starch-containing material at a temperature range of 85-95° C. using an alpha-amylase;

ii) saccharifying using a glucoamylase;

iii) fermenting using a fermenting organism to produce the ethanol;

wherein at least two polypeptides having pectinase activity are present or added during saccharifying step ii) or fermenting step iii), and wherein the at least two polypeptides having pectinase activity comprises a polygalacturonase from the GH28 family and a pectin methyl esterase from the CE8 family.

* * * * *